(12) United States Patent
Petsch et al.

(10) Patent No.: US 12,186,389 B2
(45) Date of Patent: Jan. 7, 2025

(54) NUCLEIC ACID BASE VACCINE AGAINST EMERGING SARS-CoV-2 VARIANTS

(71) Applicant: GlaxoSmithKline Biologicals SA, Rixensart (BE)

(72) Inventors: Benjamin Petsch, Tübingen (DE); Dominik Vahrenhorst, Tübingen (DE); Diego Chaves Moreno, Tübingen (DE); Janina Gergen, Tübingen (DE); Jessica Michelle Devant, Tübingen (DE); Kristina Kovacikova, Tübingen (DE); Hans Wolfgang Große, Tübingen (DE)

(73) Assignee: GlaxoSmithKline Biologicals SA (BE)

( * ) Notice: Subject to any disclaimer, the term of this patent is extended or adjusted under 35 U.S.C. 154(b) by 0 days.

(21) Appl. No.: 18/494,893

(22) Filed: Oct. 26, 2023

(65) Prior Publication Data

US 2024/0156949 A1 May 16, 2024

(30) Foreign Application Priority Data

Oct. 28, 2022 (GB) .................................. 2216023
Jan. 23, 2023 (GB) .................................. 2300950
May 30, 2023 (GB) .................................. 2308048
Aug. 4, 2023 (GB) .................................. 2311985

(51) Int. Cl.
*A61K 39/215* (2006.01)
*A61P 31/14* (2006.01)
*C07K 14/005* (2006.01)
*C07K 14/165* (2006.01)
*A61K 39/00* (2006.01)

(52) U.S. Cl.
CPC .......... *A61K 39/215* (2013.01); *A61P 31/14* (2018.01); *C07K 14/005* (2013.01); *A61K 2039/53* (2013.01); *A61K 2039/545* (2013.01); *A61K 2039/55555* (2013.01); *C07K 14/165* (2013.01); *C12N 2770/20022* (2013.01); *C12N 2770/20034* (2013.01)

(58) Field of Classification Search
None
See application file for complete search history.

(56) References Cited

U.S. PATENT DOCUMENTS

| | | | |
|---|---|---|---|
| 8,058,069 B2 | 11/2011 | Yaworski et al. |
| 8,278,036 B2 | 10/2012 | Kariko et al. |
| 8,492,359 B2 | 7/2013 | Yaworski et al. |
| 8,691,966 B2 | 4/2014 | Kariko et al. |
| 8,748,089 B2 | 6/2014 | Kariko et al. |
| 8,822,668 B2 | 9/2014 | Yaworski et al. |
| 9,006,417 B2 | 4/2015 | Yaworski et al. |
| 9,334,328 B2 | 5/2016 | Schrum et al. |
| 9,364,435 B2 | 6/2016 | Yaworski et al. |
| 9,404,127 B2 | 8/2016 | Yaworski et al. |
| 9,428,535 B2 | 8/2016 | De Fougerolles et al. |
| 9,476,055 B2 | 10/2016 | Sahin et al. |
| 9,504,651 B2 | 11/2016 | Maclachlan et al. |
| 9,518,272 B2 | 12/2016 | Yaworski et al. |
| 9,657,295 B2 | 5/2017 | Schrum et al. |
| 9,750,824 B2 | 9/2017 | Kariko et al. |
| 9,758,795 B2 | 9/2017 | Cullis et al. |
| 9,850,269 B2 | 12/2017 | DeRosa et al. |
| 9,868,692 B2 | 1/2018 | Benenato |
| 9,943,612 B2 | 4/2018 | Scharenberg et al. |
| 10,022,435 B2 | 7/2018 | Ciaramella et al. |
| 10,064,934 B2 | 9/2018 | Ciaramella et al. |
| 10,064,959 B2 | 9/2018 | Schrum et al. |
| 10,232,055 B2 | 3/2019 | Kariko et al. |
| 10,266,485 B2 | 4/2019 | Benenato |
| 10,272,150 B2 | 4/2019 | Ciaramella et al. |
| 10,442,756 B2 | 10/2019 | Benenato et al. |
| 10,493,167 B2 | 12/2019 | De Fougerolles et al. |
| 10,543,269 B2 | 1/2020 | Ciaramella et al. |
| 10,577,403 B2 | 3/2020 | De Fougerolles et al. |
| 10,583,203 B2 | 3/2020 | De Fougerolles et al. |
| 10,702,599 B2 | 7/2020 | Ciaramella et al. |
| 10,702,600 B1 | 7/2020 | Ciaramella et al. |
| 10,703,789 B2 | 7/2020 | De Fougerolles et al. |
| 10,709,779 B2 | 7/2020 | Ciaramella et al. |

(Continued)

FOREIGN PATENT DOCUMENTS

| | | |
|---|---|---|
| CN | 111228475 A | 6/2020 |
| CN | 111606980 A | 9/2020 |

(Continued)

OTHER PUBLICATIONS

Kim et al., Molecular & Cellular Toxicology, 2022, 18:1-8. (Year: 2022).*
Hastie, et al., "Structural basis for antibody-mediated neutralization of Lassa virus," Science, vol. 356, No. 6341, 2017, pp. 923-928.
Hoffmann, et al., "CVnCoV protects human ACE2 transgenic mice from ancestral B BavPat1 and emerging B.1.351 SARS-CoV-2", bioRxiv preprint, Mar. 22, 2021, 16 pages.
Holtkamp et al., "Modification of antigen-encoding RNA increases stability, translational efficacy, and T-cell stimulatory capacity of dendritic cells," Blood. vol. 108, No. 13; 2006, pp. 4009-4017.
Hsieh et al., "Structure-based design of prefusion-stabilized SARS-CoV-2 spikes," Science, vol. 369, 2020, pp. 1501-1505.

(Continued)

*Primary Examiner* — Nicole Kinsey White

(57) ABSTRACT

The present invention is directed to nucleic acids suitable for use in treatment or prophylaxis of an infection with a coronavirus, such as a Coronavirus SARS-CoV-2 variant, or a disorder related to such an infection, such as COVID-19. The present invention is also directed to compositions, and vaccines. The compositions and vaccines comprise at least one of said nucleic acid sequences, and nucleic acid sequences in association with a lipid nanoparticle (LNP). The invention is also directed to first and second medical uses of the nucleic acids, the composition, the vaccine, and the kit, and to methods of treating or preventing a coronavirus infection, such as a Coronavirus infection from a SARS-CoV-2 variant.

28 Claims, 6 Drawing Sheets

Specification includes a Sequence Listing.

(56) References Cited

U.S. PATENT DOCUMENTS

| | | |
|---|---|---|
| 10,772,975 B2 | 9/2020 | Bancel et al. |
| 10,898,574 B2 | 1/2021 | De Fougerolles et al. |
| 10,933,127 B2 | 3/2021 | Ciaramella et al. |
| 10,953,089 B1 | 3/2021 | Smith et al. |
| 10,960,070 B2 | 3/2021 | Graham et al. |
| 11,059,841 B2 | 7/2021 | DeRosa et al. |
| 11,060,107 B2 | 7/2021 | Weissman et al. |
| 11,078,242 B1 | 8/2021 | Roy et al. |
| 11,141,378 B2 | 10/2021 | Yaworski et al. |
| 11,202,793 B2 | 12/2021 | Hoge et al. |
| 11,241,493 B2 | 2/2022 | Rauch et al. |
| 11,576,966 B2 | 2/2023 | Rauch et al. |
| 11,596,686 B2 | 3/2023 | Rauch et al. |
| 2005/0032730 A1 | 2/2005 | Von Der Mulbe et al. |
| 2005/0059624 A1 | 3/2005 | Hoerr et al. |
| 2005/0250723 A1 | 11/2005 | Hoerr et al. |
| 2006/0188490 A1 | 8/2006 | Hoerr et al. |
| 2008/0025944 A1 | 1/2008 | Hoerr et al. |
| 2008/0267873 A1 | 10/2008 | Hoerr et al. |
| 2009/0324584 A1 | 12/2009 | Hoerr et al. |
| 2010/0048883 A1 | 2/2010 | Ketterer et al. |
| 2010/0189729 A1 | 7/2010 | Hoerr et al. |
| 2010/0203076 A1 | 8/2010 | Fotin-Mleczek et al. |
| 2010/0291156 A1 | 11/2010 | Barner et al. |
| 2010/0305196 A1 | 12/2010 | Probst et al. |
| 2011/0053829 A1 | 3/2011 | Baumhof et al. |
| 2011/0250225 A1 | 10/2011 | Fotin-Mleczek et al. |
| 2012/0021043 A1 | 1/2012 | Kramps et al. |
| 2012/0258046 A1 | 10/2012 | Mutzke |
| 2013/0129754 A1 | 5/2013 | Thess et al. |
| 2013/0142818 A1 | 6/2013 | Baumhof et al. |
| 2013/0259879 A1 | 10/2013 | Baumhof et al. |
| 2013/0280283 A1 | 10/2013 | Lorenz et al. |
| 2013/0295043 A1 | 11/2013 | Kallen et al. |
| 2013/0336998 A1 | 12/2013 | Kallen et al. |
| 2015/0037326 A1 | 2/2015 | Butler-Ransohoff et al. |
| 2015/0050302 A1 | 2/2015 | Thess |
| 2015/0057340 A1 | 2/2015 | Thess et al. |
| 2015/0093413 A1 | 4/2015 | Thess et al. |
| 2015/0118183 A1 | 4/2015 | Baumhof |
| 2015/0118264 A1 | 4/2015 | Baumhof et al. |
| 2015/0165006 A1 | 6/2015 | Thess et al. |
| 2015/0184195 A1 | 7/2015 | Thess et al. |
| 2015/0218554 A1 | 8/2015 | Thess |
| 2015/0306249 A1 | 10/2015 | Baumhof et al. |
| 2015/0320847 A1 | 11/2015 | Thess et al. |
| 2016/0130345 A1 | 5/2016 | Fotin-Mleczek et al. |
| 2016/0166668 A1 | 6/2016 | Kallen et al. |
| 2016/0166678 A1 | 6/2016 | Kallen et al. |
| 2016/0166710 A1 | 6/2016 | Baumhof |
| 2016/0166711 A1 | 6/2016 | Schnee et al. |
| 2016/0168207 A1 | 6/2016 | Kramps et al. |
| 2016/0168227 A1 | 6/2016 | Kallen et al. |
| 2016/0235864 A1 | 8/2016 | Schlake et al. |
| 2016/0304883 A1 | 10/2016 | Grund et al. |
| 2016/0304938 A1 | 10/2016 | Wochner |
| 2016/0326575 A1 | 11/2016 | Von Der Mülbe et al. |
| 2016/0331844 A1 | 11/2016 | Fotin-Mleczek et al. |
| 2017/0014496 A1 | 1/2017 | Fotin-Mleczek et al. |
| 2017/0029847 A1 | 2/2017 | Thess |
| 2017/0114378 A1 | 4/2017 | Wochner et al. |
| 2017/0252430 A1 | 9/2017 | Fotin-Mleczek et al. |
| 2017/0326225 A1 | 11/2017 | Rauch et al. |
| 2018/0044687 A1 | 2/2018 | Thess et al. |
| 2018/0125952 A1 | 5/2018 | Fotin-Mleczek et al. |
| 2018/0126003 A1 | 5/2018 | Hoerr |
| 2018/0142275 A1 | 5/2018 | Roos et al. |
| 2018/0147146 A1 | 5/2018 | Eber et al. |
| 2018/0148727 A1 | 5/2018 | Grund et al. |
| 2018/0201967 A1 | 7/2018 | Eber et al. |
| 2018/0208957 A1 | 7/2018 | Roos et al. |
| 2018/0214537 A1 | 8/2018 | Mutzke et al. |
| 2018/0237786 A1 | 8/2018 | Schlake et al. |
| 2018/0237817 A1 | 8/2018 | Roos et al. |
| 2018/0243219 A1 | 8/2018 | Ketterer et al. |
| 2018/0296663 A1 | 10/2018 | Hipp et al. |
| 2018/0298372 A1 | 10/2018 | Funkner et al. |
| 2018/0303925 A1 | 10/2018 | Weissman et al. |
| 2018/0312545 A1 | 11/2018 | Baumhof et al. |
| 2018/0371392 A1 | 12/2018 | Mayer et al. |
| 2019/0010485 A1 | 1/2019 | Yazdan Panah et al. |
| 2019/0017100 A1 | 1/2019 | Wochner et al. |
| 2019/0024096 A1 | 1/2019 | Schmid et al. |
| 2019/0040378 A1 | 2/2019 | Fotin-Mleczek et al. |
| 2019/0049414 A1 | 2/2019 | Wochner et al. |
| 2019/0083602 A1 | 3/2019 | Roos et al. |
| 2019/0100784 A1 | 4/2019 | Eber et al. |
| 2019/0125857 A1 | 5/2019 | Rauch et al. |
| 2019/0133950 A1 | 5/2019 | Eber et al. |
| 2019/0160164 A1 | 5/2019 | Rauch et al. |
| 2019/0177714 A1 | 6/2019 | Kunze et al. |
| 2019/0185859 A1 | 6/2019 | Fotin-Mleczek et al. |
| 2019/0194760 A1 | 6/2019 | Koch et al. |
| 2019/0225971 A1 | 7/2019 | Williams |
| 2019/0240317 A1 | 8/2019 | Ciaramella et al. |
| 2019/0241633 A1 | 8/2019 | Fotin-Mleczek et al. |
| 2019/0249219 A1 | 8/2019 | Reichert et al. |
| 2019/0336608 A1 | 11/2019 | Baumhof et al. |
| 2019/0336611 A1 | 11/2019 | Baumhof et al. |
| 2019/0343933 A1 | 11/2019 | Horscroft et al. |
| 2019/0343942 A1 | 11/2019 | Fotin-Mleczek et al. |
| 2019/0351044 A1 | 11/2019 | Jasny et al. |
| 2019/0351047 A1 | 11/2019 | Jasny et al. |
| 2019/0351048 A1 | 11/2019 | Rauch |
| 2019/0381180 A1 | 12/2019 | Baumhof et al. |
| 2020/0023076 A1 | 1/2020 | Fotin-Mleczek et al. |
| 2020/0061185 A1 | 2/2020 | Graham et al. |
| 2020/0085852 A1 | 3/2020 | Fotin-Mleczek |
| 2020/0085944 A1* | 3/2020 | Heidenreich ...... A61K 39/0011 |
| 2020/0149026 A1 | 5/2020 | Horscroft et al. |
| 2020/0163878 A1 | 5/2020 | Baumhof et al. |
| 2020/0179526 A1 | 6/2020 | Baumhof et al. |
| 2020/0197510 A1 | 6/2020 | Ciaramella et al. |
| 2020/0282046 A1 | 9/2020 | Ciaramella et al. |
| 2020/0318097 A1 | 10/2020 | Funkner et al. |
| 2020/0392572 A1 | 12/2020 | Yazdan Panah et al. |
| 2021/0023199 A1 | 1/2021 | Kallen et al. |
| 2021/0030864 A1 | 2/2021 | Petsch et al. |
| 2021/0030866 A1 | 2/2021 | Kallen et al. |
| 2021/0060175 A1 | 3/2021 | Fotin-Mleczek et al. |
| 2021/0162037 A1 | 6/2021 | Jasny et al. |
| 2021/0170017 A1 | 6/2021 | Lutz et al. |
| 2021/0222178 A1 | 7/2021 | Linke et al. |
| 2021/0228707 A1 | 7/2021 | Metkar et al. |
| 2021/0228708 A1 | 7/2021 | Smith et al. |
| 2021/0228709 A1 | 7/2021 | Smith et al. |
| 2021/0246170 A1 | 8/2021 | Langedijk et al. |
| 2021/0253645 A1 | 8/2021 | Gershoni et al. |
| 2022/0202930 A1 | 6/2022 | Roth et al. |
| 2022/0347289 A1 | 11/2022 | Chen et al. |
| 2024/0000921 A1* | 1/2024 | Muik .................... A61K 39/12 |

FOREIGN PATENT DOCUMENTS

| | | |
|---|---|---|
| CN | 111606981 A | 9/2020 |
| CN | 111647053 A | 9/2020 |
| CN | 111732638 A | 10/2020 |
| CN | 111778264 A | 10/2020 |
| CN | 111821433 A | 10/2020 |
| CN | 111333704 B | 1/2021 |
| CN | 112226445 A | 1/2021 |
| CN | 112266411 A | 1/2021 |
| CN | 111518175 B | 2/2021 |
| CN | 112300251 A | 2/2021 |
| CN | 112390863 A | 2/2021 |
| EP | 2357230 A1 | 8/2011 |
| EP | 3318248 A1 | 5/2018 |
| EP | 3336082 A1 | 6/2018 |
| EP | 3431485 A1 | 1/2019 |
| EP | 3492109 A1 | 6/2019 |
| EP | 2791160 B1 | 3/2022 |
| WO | 2002098443 A2 | 12/2002 |
| WO | 2006068663 A2 | 6/2006 |
| WO | 2006078294 A2 | 7/2006 |

(56) References Cited

FOREIGN PATENT DOCUMENTS

| | | |
|---|---|---|
| WO | 2007024708 A2 | 3/2007 |
| WO | 2008016473 A2 | 2/2008 |
| WO | 2008/077592 A1 | 7/2008 |
| WO | 2008/157688 A2 | 12/2008 |
| WO | 2009/030481 A1 | 3/2009 |
| WO | 2009/127060 A1 | 10/2009 |
| WO | 2009/149253 A2 | 12/2009 |
| WO | 2011/005799 A2 | 1/2011 |
| WO | 2011/015347 A1 | 2/2011 |
| WO | 2011/068810 A1 | 6/2011 |
| WO | 2011/069586 A1 | 6/2011 |
| WO | 2011/071931 A2 | 6/2011 |
| WO | 2011076807 A2 | 6/2011 |
| WO | 2012006369 A2 | 1/2012 |
| WO | 2012006372 A1 | 1/2012 |
| WO | 2012006377 A2 | 1/2012 |
| WO | 2012006378 A1 | 1/2012 |
| WO | 2012019780 A1 | 2/2012 |
| WO | 2012030901 A1 | 3/2012 |
| WO | 2012031043 A1 | 3/2012 |
| WO | 2012031046 A2 | 3/2012 |
| WO | 2012/116810 A1 | 9/2012 |
| WO | 2012116811 A1 | 9/2012 |
| WO | 2012118810 A2 | 9/2012 |
| WO | 2013006825 A1 | 1/2013 |
| WO | 2013033563 A1 | 3/2013 |
| WO | 2013059475 A1 | 4/2013 |
| WO | 2013143700 A2 | 10/2013 |
| WO | 2015062738 A1 | 5/2015 |
| WO | 2015101416 A1 | 7/2015 |
| WO | 2015164674 A1 | 10/2015 |
| WO | 2015188933 A1 | 12/2015 |
| WO | 2015199952 A1 | 12/2015 |
| WO | 2016091391 A1 | 6/2016 |
| WO | 2016107877 A1 | 7/2016 |
| WO | 2016165831 A1 | 10/2016 |
| WO | 2016174271 A1 | 11/2016 |
| WO | 2016176330 A1 | 11/2016 |
| WO | 2016180430 A1 | 11/2016 |
| WO | 2016184575 A1 | 11/2016 |
| WO | 2016184576 A2 | 11/2016 |
| WO | 2016022914 A1 | 12/2016 |
| WO | 2016193206 A1 | 12/2016 |
| WO | 2016193226 A1 | 12/2016 |
| WO | 2017001058 A1 | 1/2017 |
| WO | 2017004143 A1 | 1/2017 |
| WO | 2017025447 A1 | 2/2017 |
| WO | 2017/036580 A1 | 3/2017 |
| WO | 2017/053297 A1 | 3/2017 |
| WO | 2017/066781 A1 | 4/2017 |
| WO | 2017/066782 A1 | 4/2017 |
| WO | 2017/066789 A1 | 4/2017 |
| WO | 2017/066791 A1 | 4/2017 |
| WO | 2017/066793 A1 | 4/2017 |
| WO | 2017/066797 A1 | 4/2017 |
| WO | 2017/070626 A2 | 4/2017 |
| WO | 2017/075531 A1 | 5/2017 |
| WO | 2017/081082 A2 | 5/2017 |
| WO | 2017/109161 A1 | 6/2017 |
| WO | 2017/137095 A1 | 8/2017 |
| WO | 2017/140905 A1 | 8/2017 |
| WO | 2018/075827 A1 | 4/2018 |
| WO | 2018/078053 A1 | 5/2018 |
| WO | 2018/081318 A1 | 5/2018 |
| WO | 2018081480 A1 | 5/2018 |
| WO | 2018/170347 A1 | 9/2018 |
| WO | 2018/172556 A1 | 9/2018 |
| WO | 2018/211038 A1 | 11/2018 |
| WO | 2019/077001 A1 | 4/2019 |
| WO | 2019/092153 A1 | 5/2019 |
| WO | 2019/193183 A2 | 10/2019 |
| WO | 2019/222424 A1 | 11/2019 |
| WO | 2019/226925 A1 | 11/2019 |
| WO | 2019/232095 A1 | 12/2019 |
| WO | 2019/232097 A1 | 12/2019 |
| WO | 2019/232208 A1 | 12/2019 |
| WO | 2020/002525 A1 | 1/2020 |
| WO | 2020/002598 A1 | 1/2020 |
| WO | 2020/127959 A1 | 6/2020 |
| WO | 2020/128031 A2 | 6/2020 |
| WO | 2021030701 A1 | 2/2021 |
| WO | 2021123332 A1 | 6/2021 |
| WO | 2021147025 A1 | 7/2021 |
| WO | 2021151099 A1 | 7/2021 |
| WO | 2021/155323 A1 | 8/2021 |
| WO | 2021/156267 A1 | 8/2021 |
| WO | 2021/159040 A2 | 8/2021 |
| WO | 2021/159985 A1 | 8/2021 |
| WO | 2021/160036 A1 | 8/2021 |
| WO | 2021/160346 A1 | 8/2021 |
| WO | 2021/160850 A1 | 8/2021 |
| WO | 2021/160881 A1 | 8/2021 |
| WO | 2021/161043 A1 | 8/2021 |
| WO | 2021/163222 A1 | 8/2021 |
| WO | 2021/163365 A1 | 8/2021 |
| WO | 2021/163371 A1 | 8/2021 |
| WO | 2021/163398 A1 | 8/2021 |
| WO | 2021/163427 A1 | 8/2021 |
| WO | 2021/163438 A1 | 8/2021 |
| WO | 2021/163456 A1 | 8/2021 |
| WO | 2021/163536 A2 | 8/2021 |
| WO | 2021/163584 A1 | 8/2021 |
| WO | 2021/163622 A1 | 8/2021 |
| WO | 2021154763 A1 | 8/2021 |
| WO | 2021154828 A1 | 8/2021 |
| WO | 2021155760 A1 | 8/2021 |
| WO | 2021164097 A1 | 8/2021 |
| WO | 2021169255 A1 | 9/2021 |
| WO | 2021/202734 A2 | 10/2021 |
| WO | 2021209970 A1 | 10/2021 |
| WO | 2021213924 A1 | 10/2021 |
| WO | 2021213945 A1 | 10/2021 |
| WO | 2021214204 A1 | 10/2021 |
| WO | 2021/236854 A1 | 11/2021 |
| WO | 2021222304 A1 | 11/2021 |
| WO | 2021227401 A1 | 11/2021 |
| WO | 2021228842 A1 | 11/2021 |
| WO | 2021236654 A1 | 11/2021 |
| WO | 2021243122 A2 | 12/2021 |
| WO | 2021245611 A1 | 12/2021 |
| WO | 2022067010 A1 | 3/2022 |
| WO | 2022110099 A1 | 6/2022 |
| WO | 2022155524 A1 | 7/2022 |
| WO | 2022155530 A1 | 7/2022 |
| WO | 2022180219 A1 | 9/2022 |
| WO | 2023051701 A1 | 4/2023 |
| WO | 2023064907 A1 | 4/2023 |
| WO | 2023086961 A1 | 5/2023 |
| WO | 2023094713 A2 | 6/2023 |
| WO | WO-2023102448 A2 * | 6/2023 |
| WO | 2023196935 A1 | 10/2023 |

OTHER PUBLICATIONS

Huang Chaolin, et al., "Clinical features of patients infected with 2019 novel coronavirus in Wuhan, China", The Lancet, 2020; vol. 395, No. 10223; pp. 497-506.

International Preliminary Report and English translation of the Written Opinion of the International Searching Authority dated Jul. 6, 2023 for Application No. PCT/IB2021/062127.

International Search Report and Written Opinion of the International Searching Authority for International Application No. PCT/IB2021/062127, dated Jun. 13, 2022.

International Search Report dated Jun. 25, 2021 for Application No. PCT/EP2021/052455.

Invitation to Pay Additional Fees with Communication Relating to the Results ofthe Partial International Search (PCT/ISA/206) for PCT/EP2021/052455, mailed on Apr. 29, 2021.

Jackson, et al , "An mRNA Vaccine against SARS-CoV-2—Preliminary Report", The New England Journal of Medicine, vol. 383, 2020, 1920-31, (Published Jul. 14, 2020, pp. 1-12).

Jiang, et al., "SARS Vaccine Development," Emerging Infectious Diseases, vol. 11, No. 7, Jul. 2005, pp. 1016-1020.

(56) References Cited

OTHER PUBLICATIONS

Kakodkar, et al., "A Comprehensive Literature Review on the Clinical Presentation, and Management of the Pandemic Coronavirus Disease 2019 (COVID-19)", Cureus, vol. 12, No. 4, 2020 (Published Apr. 6, 2020) e7560 pp. 1-11.
Kariko, et al., "Generating the optimal mRNA for therapy: HPLC purification eliminates immune activation and improves translation of nucleoside-modified, protein-encoding mRNA," Nucleic Acids Research, Vd. 39, No. 21, Sep. 2, 2011, e142, published online (10 pages).
Kariko, et al., "Incorporation of Pseudouridine into mRNAyields. Superior Nonimmunogenic Vector with Increased Translational Capacity and Biological Stability," Mol Ther., vol. 16, No. 11, 2008, pp. 1833-1840, 18 pages total.
Kariko, et al., "Suppression of RNA Recognition tJy Toll-like Receptors: The Impact of Nucleoside Modification and the Evolutionary Origin of RNA," Immunity, vol. 23, 2005. pp. 165-175.
Ke el al., "Structures and distributions of SARS-CoV-2 spike proteins on intact virions" Nature, vol. 588, 2020, p. 498, 21 pages total.
Kirchdoerfer, R., et al: "Stabilized coronavirus spikes are resistant to conformational changes induced by receptor recognition or proteolysis", Scientific Reports, vol. 8, No. 1, Oct. 24, 2018 (Oct. 24, 2018), pp. 1-11.
Korber, et al., Tracking Changes in SAR&CoV-2 Spike: Evidence that D614G Increases Infectivity of the COVID-19 Virus, Cell, vol. 182, No. 4, 2020, pp. 812-827.
Koyama, et al., "Emergence of Drift Variants That May Affect COVID-19 Vaccine Development and Antibody Treatment," Pathogens, vol. 9, No. 342, 2020, 7 pages).
Krarup, et al., "A highly stable prefusion RSV F vaccine derived from structural analysis of the fusion mechanism," Nature Communications, vol. 6, No. 8143. 2015, pp. 1-12.
Kusters, et al., "Manufacturing Vaccines for an Emerging Viral Infection—Specific Issues Associated with the Development of a Prototype SARS Vaccine", Vaccine for Biodefense and Emerging and Neglected Diseases, 2009 (Published online Jan. 30, 2009), pp. 1-13.
Le et al., "The COVID-19 vaccine development landscape," Nat Rev Drug Disc, vol. 19, 2020, pp. 305-306.
Letko el al., "Functional assessment of cell entry and receptor usage for SARS-CoV-2 and other lineage B betacoronaviruses," Nature Microbiology, vol. 5, 2020, pp. 562-569.
Li, et al., "Preparation and Optimization of Lipid-Like Nanoparticles for mRNA Delivery." Methods in Molecular Biology, vol. 1632, pp. 207-217. 2017.
Li et al., "Structure of SARS Coronavirus Spike Receptor-Binding Domain Complexed with Receptor," Science, vol. 309, No. 5742, 2005. pp. 1864-1868.
Li and Dong, In: RNA Nano-structures: Methods and Protocols, Methods in Molecular Biology, 1632, 2017, eds. Eckart Bindewald and Bruce A. Shapiro.
Lu, et al., "Genomic characterisation and epidemiology of 2019 novel coronavirus: implications for virus origins and receptor binding," Lancet, vol. 395, Feb. 22, 2020, pp. 565-574.
MacLachlan, I., "Liposomal formulations for nucleic acid delivery", Antisense Drug Technologies, 2nd Edition, Chapter 9, 2007, p. 237, 34 pages total.
Madhi, et al., "Efficacy of the ChAdOx1 nCoV-19 Covid-19 Vaccine against the B.1.351 Variant," The New England Journal of Medicine, 2021, pp. 1-14.
Mani, et al., "Codon Optimization of the Major Antigen Encoding Genes of Diverse Strains of Influenza A Virus," Interdiscip Sci Comput Life Sci., vol. 3, 2011, pp. 36-42.
Maruggi, et al. "mRNA as a Transformative Technology for Vaccine Development to Control Infectious Diseases", Mol Ther., vol. 27, No. 4, Apr. 2019, pp. 757-772.
Morais, et al. "The Critical Contribution of Pseudouridine to mRNA COVID-19 Vaccines," Frontiers in Cell and Developmental Biology, vol. 9, Article 789427, 2021, pp. 1-9.

Motorin, et al., "RNA nucleotide methylation," WIREs RNA, vol. 2, 2011, pp. 611-631.
Motorin, et al., "RNA nucleotide methylation: 2021 update," WIREs RNA, vol. 13, 2022, pp. 1-37.
Muik, et al., "Neutralization of SARS-CoV-2 lineage B.1.1.7 pseudovirus by BNT162b2 vaccine-elicited human sera," bioRxiv preprint, Jan. 18, 2021, pp. 1-6.
NCBI Accession No. NC_045512.1, "Wuhan seafood market pneumonia virus isolate Wuhan-Hu-1, complete genome", Jan. 13, 2020, pp. 1-12.
Orlandini Von Niessen, et al., "Improving mRNA-Based Therapeutic Gene Delivery by Expression-Augmenting 3' UTRs Identified by Cellular Library Screening," Molecular Therapy, vol. 27, No. 4, 2019, pp. 824-836.
Ou, et al. "Characterization of spike glycoprotein of SARS-CoV-2 on virus entry and its immune cross-reactivity with SARS-CoV", Nature Com., vol. 1, No. 1, 2020, pp. 1-12.
Pallesen, et al. "Immunogenicity and structures of a rationally designed prefusion MERS-CoV spike antigen", PNAS, vol. 14, No. 35, 2017 (Published online Aug. 14, 2017), pp. E7348-E7357.
Pardi, et al., "Nucleoside-modified mRNA vaccines induce potent T follicular helper and germinal center B cell responses," Journal of Experimental Medicine, 2018, vol. 215, No. 6, pp. 1571-1588.
Pardi et al. "Zika virus protection by a single low dose nucleoside modified mRNA vaccination," Nature, vol. 5, No. 7644, 2017, pp. 248-251.
Pascolo, Steve, "Vaccination with Messenger RNA (mRNA)," Handbook of Experimental Pharmacology, vol. 183, 2008, pp. 221-235.
Pascolo, "Messenger RNA-based vaccines," Expert Opinion on Biological Therapy, vol. 4, No. 8, 2004, pp. 1285-1294.
Perlman, et al., "Immunopathogenesis of Coronavirus Infections: Implications for SARS," Nature Reviews Immunology, vol. 5, Dec. 2005, pp. 917-927.
Pinto et al., "Cross-neutralization of SARS-CoV-2 by a human monoclonal SARS-CoV antibody," Nature, vol. 583, 2020, p. 290, 22 pages total.
Plante, et al., "Spike mutation D614G alters SARS-CoV-2 fitness," Nature, vol. 592, No. 7852, 2021, pp. 116-121.
Polack, et al., "Safety and Efficacy of the BNT162b2 mRNA Covid-19 Vaccine," The New England Journal of Medicine, vol. 383, 2020 (Published Dec. 10, 2020 and updated Dec. 16, 2020), pp. 1-13.
Programme for 1st International mRNA Health Conference, organized by University of Tubingen, the University Hospital of Tubingen, and CureVac, Tubingen, Germany, Oct. 23-24, 2013, 15 pages.
Rauch, et al., "mRNA based SARS-CoV-2 vaccine candidate CVnCoV induces high levels of virus neutralizing antibodies and mediates protection in rodents", bioRxiv preprint, Feb. 9, 2021, pp. 1-25.
Rauch, et al., "mRNA vaccine CVnCoV protects non-human primates from SARS-CoV-2 challenge infection", bioRxiv preprint, Dec. 23, 2020, pp. 1-28.
(CHMP), "COVID-19 vaccine modema, Common name: COVID-19 mRNA Vaccine (nucleoside-modified)," Assessment Report, European Medicines Agency, Jan. 6, 2021, pp. 1-169.
"CureVac: Final Analysis of Pivotal Phase 2b/3 HERALD Study," presentation, Jul. 1, 2021.
"Final Analysis of Phase 2b/3 Clinical Trial of First Generation COVID-19 Vaccine Candidate, CVnCoV," transcript of conference call, Jul. 1, 2021.
Anderson et al. "Incorporation of pseudouridine into mRNA enhances translation by diminishing PKR activation," Nucleic Acids Research, vol. 38, No. 17, 2010, pp. 5884-5892.
Anderson et al. "Safety and Immunogenicity of SARS-CoV-2 mRNA-1273 Vaccine in Older Adults", The New England Journal of Medicine, vol. 383, 2020 (Published Sep. 29, 2020), pp. 1-12.
Andries et al., "N(1)-Methylpseudouridine-Incorporated mRNA Outperforms Pseudouridine-Incorporated mRNA by Providing Enhanced Protein Expression and Reduced Immunogenicity in Mammalian Cell Lines and Mice," Journal of Controlled Release, vol. 217, 2015, pp. 337-344.

(56) References Cited

OTHER PUBLICATIONS

Armbruster, et al., "Advances in RNA Vaccines for Preventive Indications: A Case Study of a Vaccine against Rabies." Vaccines. vol. 7, No. 132, 2019. pp. 1-12.
Baden, et al., "Efficacy and Safety of the mRNA-1273 SARS-CoV-2 Vaccine," The New England Journal of Medicine, vol. 384, 2021 (Published Dec. 30, 2020), pp. 1-14.
Ball et al., "Lipid Nanoparticle Formulations for Enhanced Co-delivery of siRNA and mRNA," Nano Letters, vol. 18, 2018, pp. 3814-3822.
Battles, et al., "Structure and immunogenicity of pre-fusion-stabilized human metapneumovirus F glycoprotein," Nature Communications, vol. 8. No. 1528, 2017, pp. 1-11.
Becerra-Flores, et al., "SARS-CoV-2 viral spike G614 mutation exhibits higher case fatality rate," International Journal of Clinical Practice. vol. 74, 2020, e13525, pp. 1-4.
Benton, et al., The effect of the O614G substitution on the structure of the spike glycoprotein of SARS-CoV-2, Proc. Natl. Acad. Sci. USA, vol. 118, No. 35, 2021, e2022586118.
Bhattacharya, et al., "D614G mutation and SARS-CoV-2: impact on S-protein structure, function, infectivity, and immunity," Applied Microbiology and Biotechnology, vol. 105, 2021, pp. 9035-9045.
Bhattachary, et al., "Global Spread of SARS-CoV-2 Subtype with Spike Protein Mutation D614G is Shaped by Human Genomic Variations that Regulate Expression of TMPRSS2 and MX1 Genes," bioRxiv, 2020, pp. 1-25, 30 pages total.
BioNTech 2021 Annual Report. "Combined Managemenl Report 2021," BioNTech, 2021, 27 pages.
BioNTech Press Release, "Pfizer and BioNTech Achieve First Authorization in the World for a Vaccine to Combat COVID-19," BioNTech, Dec. 2, 2020, 3 pages.
Burger et al., "Stabilizing Formulations for inhalable Powders of Live-Attenuated Measles Virus Vaccine," Journal of Aerosol Medicine and Pulmonary Drug Delivery, vol. 21, No. 1, Maret; 8, 2008, 3 pages.
Cai, et al., "Distinct conformational states of SARS-CoV-2 spike protein," Science, vol. 369, No. 6511, 2020, pp. 1586-1592, 12 pages total.
Carnell, et al., "SARS-CoV-2 spike protein arrested in the closed state induces potent neutralizing responses," Journal of Virology. vol. 95. No. 15, 2021, pp. 1-27.
Chan et al., "Genomic characterization of the 2019 novel human-pathogenic coronavirus isolated from a patient with atypical pneumonia after visiting Wuhan," Emerging Microbes & Infections, vol. 9, 2020, pp. 221-236.
Chan et al., "A familial clusler of pneumonia associated with the 2019 novel coronavirus indicating person-to-person transmission: a study of a family cluster," Lancet, vol. 395, Feb. 15, 2020, pp. 514-523.
Chang et al., "Synthesis and solution conformation studies of 3-substituted uridine and pseudouridine derivatives," Bioorganic & Medicinal Chemistry, vol. 16, 2008, pp. 2676-2686.
Comirnaty, "Common name: COVID-19 mRNA vaccine (nucleoside-modified)", Assessment Report, European Medicines Agency, Dec. 21, 2020, pp. 1-140.
Corbett, et al., "Evaluation of the mRNA-1273 Vaccine against SARS-CoV-2 in Nonhuman Primates", The New England Journal of Medicine, vol. 383, 2020 (Published Jul. 28, 2020 and updated Aug. 7, 2020), pp. 1-12.
Corbett, et al., "SARS-CoV-2 mRNA vaccine development enabled by prototype pathogen preparedness", bioRxiv preprint, Jun. 11, 2020, 39 pages.
Crooke. "Antisense Drug Technology: Principles, Stralegies, and Applications, Liposomal Formulations for Nucleic Acid Delivery," CRC Press, Second Edition, 2009, pp. 237-270.
CureVac, "CureVac Final Data from Phase 2b/3 Trial of First-Generation COVID-19 Vaccine Candidate, CVnCoV, Demonstrates Protection in Age Group of 18 to 60", press release, Jun. 30, 2021, 4 pages.

CureVac, "CureVac Provides Update on Phase 2b/3 Trial of First-Generation COVID-19 Vaccine Candidate, CVnCoV", press release, Jun. 16, 2021, 4 pages.
CureVac, "CureVac: Second Interim Analysis of Pivotal Phase 2b/3 HERALD Sludy", presentation, Jun. 17, 2021, pp. 1-14 (15 pages total).
CureVac, "Result of Second Interim Analysis of CureVac's Pivotal Phase 2b/3 HERALD Study", presentation, CureVac Conference Call transcript, Jun. 17, 2021, pp. 1-14.
Daniloski, et al., "The Spike D614G mutation increases SARS-CoV-2 infection of multiple human cell types," Elife, 10: e65365, 2021.
Dao, et al., "SARS-CoV-2 Infectivity and Severity of COVID-19 According to SARS-CoV-2 Variants: Current Evidence", Journal of Clinical Medicine, vol. 10, No. 12, Jun. 15, 2021, pp. 1-35.
Database EMBL Accession No. MN908947, "Severe acute respiratory syndrome coronavirus 2 isolale Wuhan-Hu-1, complete genome" 2020, pp. 1-11.
Deering, et al., "Nucleic acid vaccines: prospects for non-viral delivery of mRNA vaccines." Expert Opinion Drug Delivery, vol. 11, No. 6, 2014, pp. 885-899.
Du et al., "The spike protein of SARS-CoV—a target for vaccine and therapeutic development," Nature Reviews Microbiology, vol. 7, 2009, pp. 226-236.
Fechter et al., "Recognition of mRN.A. cap structures by viral and cellular proteins," Journal of General Virology, vol. 86, 2005, pp. 1239-1249.
Follis et al. "Furin cleavage of the SARS coronavirus spike glycoprotein enhances cell-cell fusion but does not affect virion entry," Virology, vol. 350, 2006, pp. 358-369.
Furuichi et al., "Viral and Cellular mRNA Capping: Past and Prospects," Advances in Virus Research, vol. 55, 2000, pp. 135-184.
Gebre, et al., "Optimization of non-coding regions for a non-modified mRNA COVID-19 vaccine", Nature, vol. 601, Jan. 20, 2022 (Published online Nov. 18, 2021), pp. 410-414 (18 pages total).
Gebre, et al., "Optimization of Non-Coding Regions Improves Protective Efficacy of an mRNA SARS-CoV-2 Vaccine in Nonhuman Primates", bioRxiv Preprint, Aug. 16, 2021, pp. 1-26 (36 pages total).
GenBank Accession No. MN908947.1, "Wuhan seafood market pneumonia virus isolate Wuhan-Hu-1, complete genome", Jan. 12, 2020, pp. 1-16.
GenBank Accession No. MN908947.2, "Wuhan seafood market pneumonia virus isolate Wuhan-Hu-1, complete genome", Jan. 14, 2020, pp. 1-11.
Gerhardt, et al., "A Thermostable, Flexible RNA Vaccine Delivery Platform for Pandemic Response", bioRxiv preprint, Feb. 2, 2021, pp. 1-16 and pp. 1-10 (26 pages total).
Gobeil, et al., "D614G Mutation Alters SARS-CoV-2 Spike Conformation and Enhances Protease Cleavage at the S1/S2 Junction," Cell Reports, vol. 34, 2021, p. 108630.
Goel et al., "Distinct antibody and memory B cell responses in SARS-CoV-2 naive and recovered individuals following mRNA vaccination," Science Immunology, 2021, pp. 1-19.
Gorbalenya et al., "The species Severe acute respiratory syndrome-related coronavirus: classifying 2019-nCoV and naming it SARS-CoV-2," Nature Microbiology, vol. 5, 2020, pp. 536-544.
Grifoni et al., "Targets of T Cell Responses to SARS-CoV-2 Coronavirus in Humans with COVID-19 Disease and Unexposed Individuals," Cell, vol. 181, 2020, pp. 1489-1501.
GT Rijkers, Expert Opinion on CureVac's Vaccine Utility Model DE 20 2021 003 575 U1, Hoyng Rokh Monegier, Jul. 19, 2023, 20 pages total.
Gui, et al., "Cryo-electron microscopy structures of the SARS-CoV spike glycoprotein reveal a prerequisite conformational state for receptor binding," Cell Research, vol. 27, 2017, pp. 119-129.
Hassett et al., "Optimization of Lipid Nanoparticles tor Intramuscular Administration of mRNA Vaccines," Molecular Therapy• Nucleic Acids, vol. 15, Apr. 2019, pp. 1-11.
Rauch, et al., "New Vaccine Technologies to Combat Outbreak Siluations", Frontiers in Immunology, vol. 9, Article 1963, Sep. 2018, pp. 1-24.

(56) References Cited

OTHER PUBLICATIONS

Registry Nos. 2749948-25-0, Dec. 19, 2021, 2692611-88-2, Sep. 10, 2021, 2758016-89-4, Feb. 3, 2022, 2755828-88-5. Jan. 7, 2022, 2741858-84-2, Dec. 6, 2021. 2730004-45-0, Nov. 11, 2021, 2696398-77-1, Sep. 16, 2021, and 2695574-78-6, Sep. 15, 2021, STN Database, Accessed Feb. 9, 2022.

Riley, et al., "Enhancing the Prefusion Conformational Stability of SARS-CoV-2 Spike Protein Through Structure-Guided Design," Front Immunol., 12:660198, 2021 (13 pages).

Roychoudhury, et al., "Severe acute respiratory syndrome coronavirus 2 surface glycoprotein," Database. EMBL:QIQ68534, submitted on Mar. 26, 2020, 2 pages total.

Sahin, et al., "Concurrent human antibody and TH1 type T-cell responses elicited by a COVID-19 RNA vaccine," medRxiv preprint, Jul. 20, 2020, pp. 1-18 (27 pages total).

Sahin et al., "mRNA-based therapeutics—developing a new class of drugs," Nature Reviews Drug Discover, vol. 13, 2014, pp. 759-780.

Sanders et al., "A Next-Generation Cleaved, Soluble HIV-1 Env Trimer, BG505 SOSIP.664 gp140, Expresses Multiple Epitopes for Broadly Neutralizing but Not Non-Neutralizing Antibodies," PLOS Pathogens, vol. 9, No. 9, e1003618, 2013, pp. 1-20.

Sanders, et al., "Virus vaccines: proteins prefer prolines," Cell Host & Microbe, vol. 29, 2021 pp. 327-333.

Schlake, et al., "Developing mRNA-vaccine technologies," RNA Biology, vol. 9, No. 11, 2012, pp. 1319-1330.

Schoemaker, et al., "mRNA-lipid nanopairticle COVID-19 vaccines: structure and stability," International Journal of Pharmaceutics, vol. 601, 2021, pp. 1-13.

Schrors, et al., "Large-scale analysis of SARS-CoV-2 spike-glycoprotein mutants demonstrates the need for continuous screening of virus isolates," bioRxiv preprint, Mar. 15, 2021, pp. 1-20.

Song, et al., "Cryo-EM structure of the SARS coronavirus spike glycoprotein in complex with its host cell receptor ACE2," PLOS Pathogens, vol. 14, No. 8, 2018, pp. 1-19.

Tian et al., "Potent binding of 2019 novel coronavirus spike protein by a SARS coronavirus-specific human monoclonal antibody," Emerg. Microbes Infect., vol. 9, 2020, pp. 382-385.

Toyoshima, et al., "SARS-CoV-2 genomic variations associated with mortality rate of COVID-19," J. of Hum. Gen. (2020) 65:1075-1082.

U.S. Appl. No. 62/967,006, entitled "Coronavirus RNA vaccines," filed, Jan. 28, 2020.

Van Nuffel, et al., "Dendritic Cells Loaded With mRNA Encoding Full-length Tumor Antigens Prime CD4+ and CD8+ T Cells in Melanoma Patients," Molecular Therapy, vol. 20, No. 5, 2012, pp. 1063-1074.

Vogel, et al., "A prefusion SARS-CoV-2 spike RNA vaccine is highly immunogenic and prevents lung infection in non-human primates", bioRxiv preprint, Sep. 8, 2020, pp. 1-38.

Vogel, et al., "BNT162b vaccines are immunogenic and protect non-human primates against SARS-CoV-2", bioRxiv preprint, Dec. 11, 2020, pp. 1-71.

Wan et al., "Receptor Recognition by the Novel Coronavirus from Wuhan: an Analysis Based on Decade-Long Structural Studies of SARS Coronavirus," J. of Virol, vol. 94, No. 7, 2020, pp. e00127-20.

Wang, et al, "An Evidence Based Perspective on mRNA-SARS-CoV-2 Vaccine Development", Medical Science Monitor, vol. 26, 2020 (Published May 5, 2020), pp. e924700-1-e924700-8.

Wang et al., "Structural and Functional Basis of SARS-CoV-2 Entry by Using Human ACE2," Cell, vol. 181, 2020, pp. 894, 21 pages total.

Widge, et al., "Durability of Responses after SARS-CoV-2 mRNA-1273 Vaccination", The New England Journal of Medicine, vol. 384, 2021, pp. 1-4.

Wrapp et al., "Cryo-EM structure of the 2019-nCoV spike in the prefusion conformation," Science, vol. 367, 2020, pp. 1260-1263.

Wu et al., "A new coronavirus associated with human respiratory disease in China," Nature, vol. 579, Maret; 12, 2020, 20 pages.

Xiong et al., "A thermostable, closed SARS-CoV-2 spike protein trimer," Nature structural & Molecular Biology, vol. 27, 2020, p. 934, 19 pages total.

Xue et al., "Lipid-Based Nanocarriers for RNA Delivery," Curr Pharm Des., vol. 21, No. 22, 2015, pp. 3140-3147 (doi: 10.2174/1381612821666150531164540).

Yamamoto, et al., "Current prospects for mRNA gene delivery," European Journal of Pharmaceutics and Biopharmaceutics, 2009, pp. 484-489.

Yang, et al., "D614G mutation in the SARS-CoV-2 spike protein enhances viral fitness by desensitizing it to temperature-dependent denaluralion," J. Biol. Chem., 297(4):101238, 2021.

Zaki, et al.. "Isolation of a Novel Coronavirus from a Man With Pneumonia in Saudi Arabia," The New England Journal of Medicine, vol. 367, No. 19, 2012. pp. 1814-1820.

Zhang et al., "The D614G mutation in the SARS-CoV-2 spike protein reduces S1 shedding and increases infectivity," The Scripps Research Institute, 2020, 25 pages.

Zhang, et al., "SARS-CoV-2 spike-protein D614G mutation increases virion spike density and infectivity," Nature Commun., 11(1):6013, 2020.

Zhang, et al., "Structural impact on SARS-CoV-2 spike protein by D614G substitution," Science, 372:525-530, 2021.

Zhang, et al., "Structure of SARS-CoV-2 spike protein," Curr. Opin. in Virol., 50:173-182, 2021.

Zhang, Y.et al: "Wuhan seafood market pneumonia virus isolate Wuhan-Hu-1, complete genome.", Database accession No. MN908947 abstract, Database EMBL [Online] EBI; Jan. 15, 2020 (Jan. 15, 2020).

Zhou et al., "A pneumonia outbreak associated with a new coronavirus of probable bat origin," Nature, vol. 579, Mar. 12, 2020, 20 pages.

Zhu, et al., "A Novel Coronavirus from Patients with Pneumonia in China, 2019" The New England Journal of Medicine, vol. 382, No. 8, 2020, pp. 727-733.

Yunlong Cao, et al., "Imprinted SARS-CoV-2 humoral immunity induces convergent Omicron RBD evolution", bioRxiv, Oct. 4, 2022, published as https://www.biorxiv.org/content/10.1101/2022.09.15.507787v1.full.pdf (retrieved Jan. 5, 2024).

Chakraborty Chiranjib, et al., The Rapid Emergence of multiple sublineages of Omicron (B.1.1.529) variant: Dynamic profiling via molecular phylogenetics and mutational landscape studies, Journal of Infection and Public Health, vol. 15, No. 11, Oct. 13, 2022, pp. 1234-1258.

\* cited by examiner

NUCLEIC ACID BASE VACCINE AGAINST EMERGING SARS-CoV-2 VARIANTS

CROSS REFERENCES TO RELATED APPLICATIONS

This application claims the benefit of GB2216023.8, filed Oct. 28, 2022; GB2300950.9, filed Jan. 23, 2023; GB 2308048.4, filed May 30, 2023; and GB2311985.2, filed Aug. 4, 2023; the contents of which are incorporated herein by reference in their entirety and for all purposes.

Reference to a "Sequence Listing" The Sequence Listing written in file 70259WO1_SL_XML, created 24 Oct. 2023, 1.194 kbytes in size, is hereby incorporated by reference in its entirety and for all purposes.

FIELD OF THE INVENTION

The present invention is inter alia directed to an RNA suitable for use in treatment or prophylaxis of an infection with emerging SARS-CoV-2 variants, including, but not limited to BQ.1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44, or a disorder related to such infections. The present invention also concerns compositions, polypeptides, and vaccines. The compositions and vaccines preferably comprise at least one of said RNA sequences, preferably RNA in association with lipid nanoparticles (LNPs).

BACKGROUND OF THE INVENTION

Coronaviruses are highly contagious, enveloped, positive single stranded zoonotic RNA viruses of the Coronaviridae family. Coronaviruses are genetically highly variable, and individual virus species have the potential to infect several host species by overcoming the species barrier. In late 2019, an outbreak of respiratory disease caused by a novel Coronavirus strain was reported in Asia (Wuhan City, Hubei Province, China). The novel Coronavirus was named "severe acute respiratory syndrome coronavirus 2" (SARS-CoV-2).

Typical symptoms of a SARS-CoV-2 caused virus infection, also referred to as COVID-19 disease, include fever, cough, shortness of breath, and pneumonia, with high mortality rates in the elderly population. In March 2020, the WHO declared the SARS-CoV-2 outbreak a pandemic. In addition, some individuals suffer the effects of COVID-19 infection for weeks to months after infection. This population is referred to "long Covid". Common signs and symptoms that linger over time include: fatigue, shortness of breath or difficulty breathing, cough, joint pain, chest pain, memory, concentration or sleep problems, muscle pain or headache, fast or pounding heartbeat, loss of smell or taste, depression or anxiety, fever, dizziness on standing, worsened symptoms after physical or mental activities.

Since the beginning of the pandemic, new SARS-CoV-2 variants, including some classed as variants of concern (VOCs), have appeared, each characterized by different virulence, transmissibility, and immune escape, resulting in differences in the effectiveness of public health measures, diagnostics, vaccines, or therapeutics. While B.1.1.7 (Alpha) and B.1.617.2 (Delta) spread rapidly, particularly in the naïve population, B.1.351 (Beta) and especially B.1.1.529 (Omicron) are notable for immune escape.

Several VOCs which have themselves mutated, such as Beta and Omicron, evade humoral responses elicited by vaccines based on ancestral S-protein sequences. As a result, Omicron has quickly become globally prevalent, despite high immunization rates. Unfortunately, while the SARS-CoV-2 Omicron variants appear to cause less severe disease than other variants, they do not induce relevant cross-protective neutralizing antibody (nAb) titres in SARS-CoV-2 naïve populations, meaning they may be less protected against future infection compared with those previously exposed to other variants or vaccinated.

The evolution of further emerging variants and VOCs is highly unpredictable; however, it is likely that new escape variants will emerge, such as e.g. the XBB.1.5 variant, that emerged early 2023. Therefore, continuing developing effective vaccines and vaccine strategies will remain essential in order to adapt the circulating variants.

SUMMARY OF THE INVENTION

Therefore, it is one object of the underlying invention to provide an RNA-based vaccine for SARS-CoV-2 infections, in particular SARS-CoV-2 infections caused by novel emerging SARS-CoV-2 variant strains. Such novel emerging strains include but are not limited to: BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44. RNA based vaccination represents one of the most promising techniques for new vaccines against new emerging SARS-CoV-2 viruses. RNA can be genetically engineered and adapted to new emerging SARS-CoV-2 strains and administered to a human subject, where transfected cells directly produce the encoded antigen provided by the RNA which results in immunological responses.

These objects are inter alia solved by providing an RNA comprising at least one coding sequence encoding at least one antigenic peptide or protein from a SARS-CoV-2 spike protein or an immunogenic fragment or immunogenic variant thereof, wherein the SARS-CoV-2 spike protein comprises at least one amino acid substitution deletion or insertion at a position selected from the list comprising N460, K444, T604, D574, K182, Y200, L518, E554, T572, Q675, D1153, E180, R21, V83, K97, H146, K147, N164, Q183, G184, N185, F186, P209, S256, G257, K356, L368, I410, P521, N658, I666, G798, T883, S1003, A1020, E1144, D1199 and C1243 (relative to reference sequence of SEQ ID NO: 1) or wherein the SARS-CoV-2 spike protein comprises at least one amino acid substitution corresponding to N460K, K444M, K444R, K444T, V445P, E484R, F486P, K356T, D574V, T604I, Q52H, K147N, K182N, Y200C, T478Q, L518V, E554K, Q675H, T572I, D1153Y, E180V, P25S, V83A, H146Q, K147E, Q183E, I210V, L212S, V213E, D215H, H245N, G252V, G257D, G257S, G339H, L368I, F486S, F490V, N658S, G798D, S1003I, A1020S, D1199N, K97R, N164K, P209L, S256L, I666V, R21G, H146K, G184V, N185D, F186L, P521S, T883I, E1144Q, C1243F, D80Y, T547I or I410V (relative to reference sequence of SEQ ID NO: 1). In embodiments the spike protein is derived from a SARS-CoV-2 variant (e.g. from BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44) and optionally comprises a stabilizing mutation.

As further defined in the claims and the underlying description, these objects are inter alia solved by providing an RNA comprising at least one coding sequence encoding at least one antigenic peptide or protein derived from SARS-CoV-2, e.g. comprising at least one mutation derived from a SARS-Cov-2 strain including, but not limited to BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44.

In embodiments, the RNA and RNA-based vaccine comprises an RNA encoding at least one antigenic peptide derived from a SARS-CoV-2 spike protein, e.g. comprising a spike protein derived from a SARS-Cov-2 strain including, but not limited to: BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/ EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44.

Definitions

For the sake of clarity and readability, the following definitions are provided. Any technical feature mentioned for these definitions may be read on each and every embodiment of the invention. Additional definitions and explanations may be specifically provided in the context of these embodiments.

Percentages in the context of numbers should be understood as relative to the total number of the respective items. In other cases, and unless the context dictates otherwise, percentages should be understood as percentages by weight (wt.-%).

Adaptive immune response: The term "adaptive immune response" as used herein refers to an antigen-specific response of the immune system (the adaptive immune system). Antigen specificity allows for the generation of responses that are tailored to specific pathogens or pathogen-infected cells. The ability to mount these tailored responses is usually maintained in the body by "memory cells" (B-cells). In the context of the invention, the antigen is provided by an RNA encoding at least one antigenic peptide or protein derived from SARS-CoV-2, e.g. from a SARS-CoV-2 strain including, but not limited to: BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/ FL.1.3, FV.1, XBB.1.16.6, XBB.1.19.1, XBB.1.22.1, EL.1, XAY-1.1.1 and/or XBB.1.5.44.

In embodiments, the antigen is provided by an RNA encoding at least one antigenic peptide derived from a SARS-CoV-2 spike protein, e.g. comprising a spike protein derived from a SARS-Cov-2 strain including, but not limited to: BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44. As used herein, EG.1 and EG.1.3 share the same spike protein sequence. As used herein, EG.5, EF.1 and XBB.1.18.1.1 share the same spike protein sequence. As used herein, FL.1 and FL.1.3 share the same spike protein sequence.

Antigen: The term "antigen" refer or refers to a substance which may be recognized by the immune system, preferably by the adaptive immune system, and is capable of triggering an antigen-specific immune response, e.g. by formation of antibodies and/or antigen-specific T cells as part of an adaptive immune response. Typically, an antigen may be or may comprise a peptide, protein, or a fragment thereof, which may be presented by the MHC to T-cells. Also included as antigens are fragments, variants and derivatives of peptides or proteins derived from a spike protein (S) of a SARS-Cov-2 strain including, but not limited to: BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/ FL.1.3, FV.1, XBB.1.16.6, XBB.1.19.1, XBB.1.22.1, EL.1, XAY-1.1.1 and/or XBB.1.5.44, comprising at least one epitope. In embodiments, an antigen is the product of translation of a provided RNA as specified herein.

Antigenic peptide or protein: The term "antigenic peptide or protein" or "immunogenic peptide or protein" refer or refers to a peptide, protein derived from a (antigenic or immunogenic) protein, or a fragment thereof, which stimulates the body's adaptive immune system to provide an adaptive immune response. An antigenic/immunogenic peptide or protein comprises at least one epitope or antigen of the protein it is derived from, or a fragment thereof, for example, the spike protein (S) of SARS-CoV-2 including, but not limited to: BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/ EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44.

At least one: The term "at least one" as used herein means 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 44, 45, 46, 47, 48, 49, 50, or more. Illustratively, the term "at least one" may refer to amino acid substitution(s), deletion(s) or insertion(s), epitope(s), coding sequence(s), antigenic peptide(s), SARS CoV-2 variant(s), SARS CoV-2 spike protein(s), RNA(s), composition(s) according to the instant invention.

Cationic: As used herein, the term "cationic" means that the respective structure bears a positive charge, either permanently or not permanently, in response to certain conditions such as pH. Thus, the term "cationic" covers both "permanently cationic" and "cationisable" or "ionizable".

Cationisable: The term "cationisable" as used herein means that a compound, or group or atom, is positively charged at a lower pH and uncharged at a higher pH of its environment. In non-aqueous environments where no pH value can be determined, a cationisable compound, group or atom is positively charged at a high hydrogen ion concentration and uncharged at a low concentration or activity of hydrogen ions, depending on the individual properties of the cationisable or polycationisable compound, such as the pKa of the respective cationisable group or atom, at which pH or hydrogen ion concentration it is charged or uncharged. In diluted aqueous environments, the fraction of cationisable compounds, groups or atoms bearing a positive charge may be estimated using the Henderson-Hasselbalch equation, which is well-known to a person skilled in the art. In some embodiments, if a compound or moiety is cationisable, it is positively charged at a pH value of about 1 to 9. In embodiments, the compound or moiety is positively charged at a pH value of about 4 to 9, 5 to 8 or 6 to 8. In embodiments, the compound or moiety is positively charged at a pH value of or below 9. In embodiments, the compound or moiety is positively charged at a pH value below 8. In embodiments, the compound or moiety is positively charged at a pH value below 7. In embodiments, the compound or moiety is positively charged at physiological pH values, such as about 7.3 to 7.4, i.e. under physiological conditions. In embodiments, the compound or moiety is positively charged under physiological salt conditions of the cell in vivo. In embodiments, the cationisable compound or moiety is predominantly neutral at physiological pH values, e.g. about 7.0-7.4, but becomes positively charged at lower pH values. In embodiments, the range of pKa for the cationisable compound or moiety is about 5 to about 7.

Coding sequence/coding region: The terms "coding sequence" or "coding region" and the corresponding abbreviation "cds" refer to a sequence of several nucleotide triplets, which may be translated into a peptide or protein. A coding sequence in the context of the present invention may be an RNA sequence, such as an mRNA sequence consisting of a number of nucleotides that may be divided by three, which starts with a start codon and which terminates with a stop codon.

COVID-19 disease: The term "COVID-19" or "COVID-19 disease" as used herein refers to the disease caused by a SARS-CoV-2 virus infection.

Derived from: The term "derived from" as used throughout the present specification in the context of a nucleic acid, i.e. for a nucleic acid "derived from" (another) nucleic acid, means that the nucleic acid, which is derived from (another) nucleic acid, shares e.g. at least 60%, 70%, 80%, 81%, 82%, 83%, 84%, 85%, 86%, 87%, 88%, 89%, 90%, 91%, 92%, 93%, 94%, 95%, 96%, 97%, 98%, 99%, 99.1%, 99.2%, 99.3%, 99.4%, 99.5%, 99.6%, 99.7%, 99.8% or 99.9% sequence identity with the nucleic acid from which it is derived. The skilled person is aware that sequence identity is typically calculated for the same types of nucleic acids, i.e. for DNA sequences or for RNA sequences. Thus, it is understood, if a DNA is "derived from" an RNA or if an RNA is "derived from" a DNA, in a first step the RNA sequence is converted into the corresponding DNA sequence (in particular by replacing the uracils (U) by thymidines (T) throughout the sequence) or, vice versa, the DNA sequence is converted into the corresponding RNA sequence (in particular by replacing the T by U throughout the sequence). Thereafter, the sequence identity of the DNA sequences or the sequence identity of the RNA sequences is determined. Preferably, a nucleic acid "derived from" a nucleic acid also refers to nucleic acid, which is modified in comparison to the nucleic acid from which it is derived, e.g. in order to increase RNA stability even further and/or to prolong and/or increase protein production. In the context of amino acid sequences (e.g. antigenic peptides or proteins) the term "derived from" means that the amino acid sequence, which is derived from (another) amino acid sequence, shares e.g. at least 60%, 70%, 75%, 80%, 81%, 82%, 83%, 84%, 85%, 86%, 87%, 88%, 89%, 90%, 91%, 92%, 93%, 94%, 95%, 96%, 97%, 98%, 99%, 99.1%, 99.2%, 99.3%, 99.4%, 99.5%, 99.6%, 99.7%, 99.8% or 99.9% sequence identity with the amino acid sequence from which it is derived.

Epitope: The term "epitope" (also called "antigen determinant" in the art) as used herein refers to T cell epitopes and B cell epitopes. T cell epitopes or parts of the antigenic peptides or proteins may comprise fragments having a length of about 6 to about 20, e.g. about 6, 7, 8, 9, 10, 11, 12, 13, 14, 15, 16, 17, 18, 19 or 20, or even more amino acids, e.g. fragments as processed and presented by MHC class I molecules, having a length of about 8 to about 10 amino acids, e.g. 8, 9, or 10, (or even 11, or 12 amino acids), or fragments as processed and presented by MHC class II molecules, having a length of about 13 to about 20, e.g. about 13, 14, 15, 16, 17, 18, 19 or 20, or even more amino acids. These fragments are typically recognized by T cells in form of a complex consisting of the peptide fragment and an MHC molecule, i.e. the fragments are typically not recognized in their native form. B cell epitopes are typically fragments located on the outer surface of (native) protein or peptide antigens, having about 5 to about 15 amino acids. In embodiments, the fragments have about 5, 6, 7, 8, 9, 10, 11, 12, 13, 14 or 15 amino acids. In embodiments, the fragments have about 5 to about 12 amino acids, e.g. about 5, 6, 7, 8, 9, 10, 11 or 12 amino acids. In embodiments, the fragments have about 6 to about 9 amino acids, e.g. about 6, 7, 8 or 9 amino acids, which may be recognized by antibodies, i.e. in their native form. Such epitopes of proteins or peptides may furthermore be selected from any of the herein mentioned variants of such proteins or peptides. In this context epitopes can be conformational or discontinuous epitopes which are composed of segments of the proteins or peptides as defined herein that are discontinuous in the amino acid sequence of the proteins or peptides as defined herein but are brought together in the three-dimensional structure or continuous or linear epitopes which are composed of a single polypeptide chain.

Fragment: The term "fragment" as used herein in the context of a nucleic acid sequence (e.g. RNA or DNA) or an amino acid sequence may typically be a shorter portion of a full-length sequence of e.g. a nucleic acid sequence or an amino acid sequence, while still retaining its intended function. Accordingly, a fragment, typically, consists of a sequence that is identical to the corresponding stretch within the full-length sequence, and hence does not encompass the full-length sequence. A preferred fragment of a sequence in the context of the present invention, consists of a continuous stretch of entities, such as nucleotides or amino acids corresponding to a continuous stretch of entities in the molecule the fragment is derived from, which represents at least 40%, 50%, 60%, 70%, 80%, 81%, 82%, 83%, 84%, 85%, 86%, 87%, 88%, 89%, 90%, 91%, 92%, 93%, 94%, 95%, 96%, 97%, 98%, 99%, 99.5% of the total (i.e. full-length) molecule from which the fragment is derived (e.g. spike protein (S) of SARS-CoV-2, e.g. from spike protein (S) of a SARS-Cov-2 strain including, but not limited to: BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44. The term "fragment" as used herein in the context of proteins or peptides may, typically, comprise a sequence of a protein or peptide as defined herein, which is, with regard to its amino acid sequence, N-terminally and/or C-terminally truncated compared to the amino acid sequence of the original protein. The term "fragment" as used throughout the present specification in the context of RNA sequences may, typically, comprise an RNA sequence that is 5'-terminally and/or 3'-terminally truncated compared to the reference RNA sequence. Such truncation may thus occur either on the amino acid level or correspondingly on the nucleic acid level. A sequence identity with respect to such a fragment as defined herein may therefore preferably refer to the entire protein or peptide as defined herein or to the entire (coding) nucleic acid molecule of such a protein or peptide. Fragments of proteins or peptides may comprise at least one epitope of those proteins or peptides.

A fragment of a protein comprises a functional fragment or an immunogenic fragment of the protein, which means, in the context of the invention, that the fragment exerts essentially the same, or at least 40%, 50%, 60%, 70%, 75%, 80%, 85%, 90%, 95%, 98% or more of the immunogenicity as the protein it is derived from.

Fragments of SARS-Cov-2 spike protein (S) are:
spike protein fragment S1: amino acid position aa 1 to aa 681;
receptor binding domain (RBD): amino acid position aa 319 to aa 541;
critical neutralisation domain (CND): amino acid position aa 329 to aa 529.

Amino acid positions refer to SEQ ID NO: 1 as a reference protein sequence. The at least one amino acid substitution, deletion or insertion according to the invention refer to positions relative to the sequence to SEQ ID NO: 1.

Heterologous: The terms "heterologous" or "heterologous sequence" as used throughout the present specification in the context of a nucleic acid sequence or an amino acid sequence refers to a sequence (e.g. RNA, DNA, amino acid) that is derived from another gene, another allele, or e.g. another species or virus. Two sequences are typically understood to be "heterologous" if they are not derivable from the same gene or from the same allele. I.e., although heterologous sequences may be derivable from the same organism or virus, in nature, they do not occur in the same nucleic acid or protein.

Humoral immune response: The terms "humoral immunity" or "humoral immune response" refers to B-cell mediated antibody production and optionally to accessory processes accompanying antibody production. A humoral immune response is typically characterized by Th2 activation and cytokine production, germinal center formation and isotype switching, affinity maturation and memory cell generation. Humoral immunity may also refer to the effector functions of antibodies, which include pathogen and toxin neutralization, classical complement activation, and opsonin promotion of phagocytosis and pathogen elimination.

Identity (of a sequence): The term "identity" as used throughout the present specification in the context of a nucleic acid sequence or an amino acid sequence refers to the percentage to which two sequences are identical over the full/entire length thereof or over a specific designated portion, region or domain thereof. For example, there is at least 40%, 50%, 60%, 70%, 80%, 81%, 82%, 83%, 84%, 85%, 86%, 87%, 88%, 89%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% identity over the full/entire length thereof or over a specific designated portion, region or domain thereof. To determine the percentage to which two sequences are identical, e.g. nucleic acid sequences or amino acid (aa) sequences as defined herein, preferably the aa sequences encoded by the nucleic acid sequence as defined herein or the aa sequences themselves, the sequences can be aligned in order to be subsequently compared to one another. Therefore, e.g. a position of a first sequence may be compared with the corresponding position of the second sequence. If a position in the first sequence is occupied by the same residue as is the case at a position in the second sequence, the two sequences are identical at this position. If this is not the case, the sequences differ at this position. If insertions occur in the second sequence in comparison to the first sequence, gaps can be inserted into the first sequence to allow a further alignment. If deletions occur in the second sequence in comparison to the first sequence, gaps can be inserted into the second sequence to allow a further alignment. The percentage to which two sequences are identical is then a function of the number of identical positions divided by the total number of positions including those positions which are only occupied in one sequence. The percentage to which two sequences are identical can be determined using an algorithm, e.g. an algorithm integrated in the BLAST program.

Immunogen, immunogenic: The terms "immunogen" or "immunogenic" refers to a compound that is able to stimulate/induce an immune response. An immunogen may be a peptide, polypeptide, protein, a fragment or a variant thereof. An immunogen is the product of translation of a provided RNA comprising at least one coding sequence encoding at least one antigenic peptide, protein derived from spike protein of SARS-CoV-2, e.g. a protein derived from a spike protein of a SARS-CoV-2 strain including, but not limited to: BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44, as defined herein. Typically, an immunogen elicits an adaptive immune response.

Immune response: The term "immune response" refers to a specific reaction of the adaptive immune system to a particular antigen (so called specific or adaptive immune response) or an unspecific reaction of the innate immune system (so called unspecific or innate immune response), or a combination thereof. A suitable vaccine induces an efficient immune response in a normal healthy recipient to whom the vaccine is administered. With an efficient immune response one vaccination will result in virus-neutralizing antibody titers. In addition, or alternatively, an efficient immune response will elicit an adaptive immune response. In some embodiments the efficient immune response will reduce coronavirus infection by at least 50% relative to a neutralizing antibody titer of an unvaccinated control subject. In some embodiments, an efficient immune response will be one where the neutralizing antibody titer and/or a T cell immune response is sufficient to reduce the rate of asymptomatic viral infection relative to the neutralizing antibody titer of unvaccinated control subjects. An efficient immune response may also be one where the neutralizing antibody titer and/or a T cell immune response is sufficient to prevent viral latency in the subject and/or the neutralizing antibody titer is sufficient to block fusion of virus with epithelial cells of the subject. In some embodiments an efficient immune response is one in which administration of a therapeutically effective amount of the nucleic acid, the composition, or the vaccine to a subject induces a T cell immune response against coronavirus in the subject. In embodiments, the T cell immune response comprises a CD4+ T cell immune response and/or a CD8+ T cell immune response. In further aspects, an efficient immune response is one in which the immune response protects the subject from severe COVID-19 disease for at least about 6 months and/or reduce the incidence of hospitalization compared to an unvaccinated person. An efficient immune response may also reduce the transmission of virus due compared to transmission from an unvaccinated person infected with the virus. An efficient immune response may also be considered as one which provide some protection against variants due to heterologous immune responses.

Immune system: The term "immune system" refers to a system of the organism that may protect the organisms from infection. If a pathogen succeeds in passing a physical barrier of an organism and enters this organism, the innate immune system provides an immediate, but non-specific response. If pathogens evade this innate response, vertebrates possess a second layer of protection, the adaptive immune system. Here, the immune system adapts its response during an infection to improve its recognition of the pathogen. This improved response is then retained after the pathogen has been eliminated, in the form of an immunological memory, and allows the adaptive immune system to mount faster and stronger attacks each time this pathogen is encountered. According to this, the immune system comprises the innate and the adaptive immune system. Each of these two parts typically contains so called humoral and cellular components.

Innate immune system: The term "innate immune system" (also known as non-specific or unspecific immune system) refers to a system typically comprising the cells and mechanisms that defend the host from infection by other organisms in a non-specific manner. This means that the cells of the innate immune system may recognize and respond to pathogens in a generic way, but unlike the adaptive immune system, it does not confer long-lasting or protective immunity to the host. The innate immune system may be activated by ligands of pattern recognition receptor e.g. Toll-like receptors, NOD-like receptors, or RIG-1 like receptors etc.

Lipidoid compound: A lipidoid compound, also referred to as lipidoid, is a lipid-like compound, i.e. an amphiphilic compound with lipid-like physical properties. In the context of the present invention, the term lipid is considered to encompass lipidoid compounds.

Multivalent composition: The term "multivalent composition" or "multivalent vaccine" as used herein refers to a composition or a vaccine prepared from two or more strains of the same species, and consequently containing antigenic compounds from said two or more strains of the same species. E.g., a multivalent composition or vaccine, as used herein, may comprise antigens from at least two SARS CoV-2 variants, such as at least two antigenic peptides or proteins derived from spike protein of SARS-CoV-2.

Permanently cationic: The term "permanently cationic" as used herein means that the respective compound, or group, or atom, is positively charged at any pH value or hydrogen ion activity of its environment. Typically, the positive charge results from the presence of a quaternary nitrogen atom. Where a compound carries a plurality of such positive charges, it may be referred to as permanently polycationic.

Receptor Binding Domain: The term "Receptor Binding Domain" or "RBD" refers to the domain of the spike protein of SARS-CoV-2 that interacts with the ACE2 receptor on eukaryotic cells.

RNA sequence: The term "RNA sequence" refers to a particular and individual order of the succession of its ribonucleotides. In some embodiments, the RNA is a messenger RNA, also referred to herein as to mRNA.

Stabilized RNA: The term "stabilized RNA" refers to an RNA that is modified such that it is more stable to disintegration or degradation, e.g., by environmental factors or enzymatic digest, such as by exo- or endonuclease degradation, compared to an RNA without such modification. A stabilized RNA in the context of the present invention is stabilized in a cell, such as a prokaryotic or eukaryotic cell, a mammalian cell, or a human cell. The stabilization effect may also be exerted outside of cells in a buffer solution for storage of a composition comprising the stabilized RNA.

T-cell responses: The terms "cellular immunity" or "cellular immune response" or "cellular T-cell responses" as used herein refer to the activation of macrophages, natural killer cells (NK), antigen-specific cytotoxic T-lymphocytes, and the release of various cytokines in response to an antigen. Cellular immunity is not based on antibodies, but on the activation of cells of the immune system. Typically, a cellular immune response may be characterized by activating antigen-specific cytotoxic T-lymphocytes that are able to induce apoptosis in cells, e.g. specific immune cells like dendritic cells or other cells, displaying epitopes of foreign antigens on their surface.

UTR: The term "untranslated region" or "UTR" or "UTR element" refers to a part of a nucleic acid molecule typically located 5' or 3' located of a coding sequence. An UTR is not translated into protein. An UTR may be part of a nucleic acid, e.g. a DNA or an RNA. An UTR may comprise elements for controlling gene expression, also called regulatory elements. Such regulatory elements may include ribosomal binding sites, miRNA binding sites etc. In certain aspects, a UTR sequence is heterologous relative to the coding sequence (i.e., the UTR is derived from a different gene or different organism than the coding sequence).

3'-UTR: The term "3'-untranslated region" or "3'-UTR" or "3'-UTR element" refers to a part of a nucleic acid molecule located 3' (i.e. downstream) of a coding sequence and which is not translated into protein. A 3'-UTR may be part of an RNA, located between a coding sequence and an (optional) poly(A) sequence. A 3'-UTR may comprise elements for controlling gene expression, also called regulatory elements. Such regulatory elements may include ribosomal binding sites, miRNA binding sites etc.

5'-UTR: The term "5'-untranslated region" or "5'-UTR" or "5'-UTR element" refers to a part of a nucleic acid molecule located 5' (i.e. upstream) of a coding sequence and which is not translated into protein. A 5'-UTR may be part of an RNA, located between a coding sequence and an (optional) 5' cap. A 5'-UTR may comprise elements for controlling gene expression, also called regulatory elements. Such regulatory elements may include ribosomal binding sites, miRNA binding sites etc.

Variant (of a sequence): The term "variant" as used herein in the context of a nucleic acid sequence refers to a variant of a nucleic acid sequence (e.g. RNA or DNA) derived from another nucleic acid sequence. E.g., a variant of a nucleic acid sequence may exhibit one or more nucleotide deletions, insertions, additions and/or substitutions compared to the nucleic acid sequence from which the variant is derived. A variant of a nucleic acid sequence may at least 40%, 50%, 60%, 70%, 80%, 81%, 82%, 83%, 84%, 85%, 86%, 87%, 88%, 89%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% identical to the nucleic acid sequence the variant is derived from. The variant is a functional variant in the sense that the variant has retained at least 40%, 50%, 60%, 70%, 80%, 81%, 82%, 83%, 84%, 85%, 86%, 87%, 88%, 89%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% or more of the function of the sequence where it is derived from. In one embodiment a "variant" of a nucleic acid sequence may have at least 40%, 50%, 60%, 70%, 80%, 81%, 82%, 83%, 84%, 85%, 86%, 87%, 88%, 89%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% nucleotide identity over a stretch of at least 10, 20, 30, 50, 75 or 100 nucleotides of such nucleic acid sequence. The term "variant" as used herein in the context of proteins or peptides refers to a protein or peptide variant having an amino acid sequence which differs from the original sequence in one or more mutation(s)/substitution(s), such as one or more substituted, inserted and/or deleted amino acid(s). For example, in some aspects, an insertion in a protein sequence comprises an insertion of 1 to 10 amino acids, such 1, 2, 3, 4, 5, 6, 7 8, 9 or 10 consecutive amino acids. These fragments and/or variants may have the same, or a comparable specific antigenic property (immunogenic variants, antigenic variants). Insertions and substitutions are possible at those sequence positions which cause no modification to the three-dimensional structure or do not affect the binding region. Modifications to a three-dimensional structure by insertion(s) or deletion(s) can easily be determined e.g. using CD spectra (circular dichroism spectra). A "variant" of a protein or peptide may have at least 40%, 50%, 60%, 70%, 80%, 81%, 82%, 83%, 84%, 85%, 86%, 87%, 88%, 89%, 90%, 91%, 92%, 93%, 94%, 95%, 96%, 97%, 98%, 99%, 99.1%, 99.2%, 99.3%, 99.4%, 99.5%, 99.6%, 99.7%, 99.8%, 99.9% amino acid identity over a stretch of at least 10, 20, 30, 50, 75 or 100 amino acids or over the entire length of such protein or peptide. A variant of a protein may comprise a functional variant or an immunogenic variant of the protein, which means, in the context of the invention, that the variant exerts essentially the same, or at least 40%, 50%, 60%, 70%, 75%, 80%, 85%, 90%, 95%, 98% or more of the immunogenicity as the protein it is derived from.

SHORT DESCRIPTION OF THE INVENTION

The present invention is based, in part, on the finding that RNA encoding spike proteins comprising at least one specific amino acid substitution, deletion or insertion or spike proteins derived from SARS-CoV-2 variants can be efficiently expressed in human cells and induce an antibody response in animals that broadly neutralizes different SARS-CoV-2 variants, e.g. a SARS-Cov-2 strain including, but not limited to: B.1.1.529 (Omicron), BA.1 (Omicron), BA.2 (Omicron), BA.4 (Omicron), BA.5 (Omicron), B.1.1.7 (Alpha), B.1.351 (Beta), P.1 (Gamma), B.1.617.2 (Delta), C.37 (Lambda), BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44. Moreover, mixtures of RNA encoding spike proteins comprising at least one specific amino acid substitution, deletion or insertion or different SARS-CoV-2 spike protein variants are also shown to be effective in producing neutralizing antibodies to a range of SARS-CoV-2 variants. These findings provide basis for new RNA-based coronavirus vaccines.

RNA sequences, composition, or vaccines as described herein have at least some of the following advantageous features:

Translation of the RNA at the site of injection/vaccination (e.g. in muscle tissue);
Very efficient induction of antigen-specific immune responses against the encoded SARS-CoV-2 protein at a very low dosage and dosing regimen;
Suitability for vaccination of infants and/or newborns or the elderly, in particular the elderly;
Suitability of the composition/vaccine for intramuscular administration;
Induction of specific and functional humoral immune response against SARS-CoV-2 variants;
Induction of broad, functional cellular T-cell responses against SARS-CoV-2 variants;
Induction of specific B-cell memory against SARS-CoV-2 variants;
Induction of functional antibodies that can effectively neutralize the SARS-CoV-2 virus variants;
Induction of functional antibodies that can also effectively neutralize the original SARS-CoV-2 virus;
Eliciting of mucosal IgA immunity by inducing of mucosal IgA antibodies;
Induction of a well-balanced B cell and T cell responses;
Induction of protective immunity against SARS-CoV-2 variants;
Fast onset of immune protection against SARS-CoV-2 variants;
Longevity of the induced immune responses against SARS-CoV-2 variants;
No enhancement of a SARS-CoV-2 infection due to vaccination or immunopathological effects;
No antibody dependent enhancement (ADE) caused by the RNA based SARS-CoV-2 vaccine;

No excessive induction of systemic cytokine or chemokine response after application of the vaccine, which could lead to an undesired high reactogenicity upon vaccination;

Well tolerability, no side-effects, non-toxicity of the vaccine;

Advantageous stability characteristics of the RNA-based vaccine;

Speed, adaptability, simplicity and scalability of SARS-CoV-2 variant vaccine production;

Advantageous vaccination regimen that only requires one or two vaccination(s) for sufficient protection;

Advantageous vaccination regimen that only requires a low dose of the vaccine for sufficient protection;

Advantageous vaccination regimen that only requires a low dose of the composition/vaccine for sufficient protection which allows the combination of different antigen providing RNAs for multivalent vaccines;

Boostability of an existing immunity against SARS-CoV-2, preferably inducing additional immune responses against SARS-CoV-2 variants;

Induction of different, SARS-CoV-2 strain specific immune responses in subjects that have been exposed to a different a strain or that have been vaccinated with a vaccine against a different strain;

Induction of a broad immune response across various SARS-CoV-2 variants;

Induction of a broad immune response across emerging and immune-evasive SARS-CoV-2 variants.

The SARS-CoV-2 variants may be selected from B.1.1.529 (Omicron), BA.1 (Omicron), BA.2 (Omicron), BA.4 (Omicron), BA.5 (Omicron), B.1.1.7 (Alpha), B.1.351 (Beta), P.1 (Gamma), B.1.617.2 (Delta), C.37 (Lambda), BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44, or from new emerging SARS-CoV.2 variants.

In a first aspect, the present invention provides an RNA encoding at least one SARS-CoV-2 spike protein or an immunogenic fragment or immunogenic variant thereof, wherein the SARS-CoV-2 spike protein comprises at least one amino acid substitution, deletion or insertion, wherein the at least one amino acid substitution, deletion or insertion is located at a corresponding position selected from the group comprising: N460, K444, T604, D574, K182, Y200, L518, E554, T572, Q675, D1153, E180, R21, V83, K97, H146, K147, N164, Q183, G184, N185, F186, P209, S256, G257, K356, L368I, I410, P521, N658, I666, G798, T883, S1003, A1020, E1144, D1199 and C1243, relative to the sequence of SEQ ID NO: 1.

In further embodiments, the RNA of the first aspect comprises at least one coding sequence encoding at least one SARS-CoV-2 spike protein or an immunogenic fragment or immunogenic variant thereof, wherein the SARS-CoV-2 spike protein comprises at least one amino acid substitution corresponding to: N460K, K444M, K444R, K444T, V445P, E484R, F486P, K356T, D574V, T604I, Q52H, K147N, K182N, Y200C, T478Q, L518V, E554K, Q675H, T572I, D1153Y, E180V, P25S, V83A, H146Q, K147E, Q183E, I210V, L212S, V213E, D215H, H245N, G252V, G257D, G257S, G339H, L368I, N450D, F486S, F490V, N658S, G798D, S1003I, A1020S, D1199N, K97R, N164K, P209L, S256L, I666V, R21G, H146K, G184V, N185D, F186L, P521S, T883I, E1144Q, C1243F, D80Y, T547I or I410V, relative to the sequence of SEQ ID NO: 1.

In certain embodiments, the RNA encodes a SARS-CoV-2 spike protein that comprises at least one amino acid substitution, deletion or insertion at a position from a SARS-CoV-2 variant spike protein (e.g. from a SARS-Cov-2 strain including, but not limited to: BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44.

In a second aspect, the present invention provides a composition, such as an immunogenic composition comprising at least one RNA of the first aspect. Suitably, the composition comprises at least one RNA of the first aspect formulated in lipid-based carriers, such as in lipid nanoparticles (LNPs). In embodiments, the second aspect relates to multivalent compositions, such as compositions comprising RNAs encoding SARS-CoV-2 spike proteins having different amino acid coding sequences (e.g. the SARS-CoV-2 spike proteins comprising at least one amino acid substitution, deletion or insertion, or spike proteins from more than one SARS-CoV-2 strain, including more than one SARS-CoV-2 variant strain, e.g. spike proteins from more than one more SARS-Cov-2 strain including, but not limited to: BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44.

In a third aspect, the present invention provides a SARS-CoV-2 variant vaccine, wherein the vaccine comprises at least one RNA of the first aspect, or at least one composition of the second aspect. In embodiments, the third aspect relates to multivalent SARS-CoV-2 vaccines. In embodiments, the third aspect relates to SARS-CoV-2 variant booster vaccines. The SARS-CoV-2 variant booster vaccines may be for one or more SARS-CoV-2 strains including, but not limited to: BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44.

In a fourth aspect, the present invention provides a kit or kit of parts comprising at least one RNA of the first aspect, and/or at least one composition of the second aspect, and/or at least one SARS-CoV-2 variant vaccine of the third aspect.

Further aspects of the invention concern a method of treating or preventing a disorder, e.g a SARS-CoV-2 infection in a subject, and first and second medical uses of RNA, compositions, and vaccines. Also provided are methods of manufacturing the nucleic acid, the composition, or the vaccine.

DETAILED DESCRIPTION OF THE INVENTION

The present application is filed together with a sequence listing for sequences SEQ ID NO. 1 to 315 in electronic format, which is part of the description of the present application (WIPO standard ST.26). The information contained in the sequence listing is incorporated herein by reference in its entirety. Where reference is made herein to a "SEQ ID NO", the corresponding nucleic acid sequence or amino acid (aa) sequence in the sequence listing having the respective identifier is referred to. For many sequences, the sequence listing also provides additional detailed information, e.g. regarding certain structural features, sequence optimizations, GenBank (NCBI) or GISAID (epi) identifiers, or additional detailed information regarding its coding capacity. In particular, such information on the specific sequences is provided under "feature key", i.e. "source" (for nucleic acids or proteins) or "misc_feature" (for nucleic acids) or "REGION" (for proteins)].

RNA Suitable for a SARS-CoV-2 Variant Vaccine:

In a first aspect, the invention relates to an RNA suitable for a SARS-CoV-2 variant vaccine.

Specific features and embodiments that are described in the context of the first aspect of the invention, that is the RNA of the invention, are likewise applicable to the second aspect (composition of the invention), the third aspect (vaccine of the invention), the fourth aspect (kit or kit of parts of the invention), or further aspects including medical uses and method of treatments.

The RNA of the first aspect forms the basis for an RNA based composition or vaccine. Generally, protein-based vaccines, or live attenuated vaccines, are suboptimal for use in developing countries due to their high production costs. In addition, protein-based vaccines, or live attenuated vaccines require long development times and are not suitable for rapid responses of pandemic virus outbreaks such as the SARS-CoV-2 outbreak in 2019/2020. In contrast, RNA-based vaccines according to the present invention allow very fast and cost-effective production. Therefore, in comparison with known vaccines, vaccine based on the inventive RNA can be produced significantly cheaper and faster, which is very advantageous particularly for use in developing countries. One further advantage of a vaccine based on RNA may be its temperature-stability in comparison to protein or peptide-based vaccines.

In embodiments, the first aspect of the invention relates to an RNA comprising at least one coding sequence encoding at least one antigenic peptide or protein from a SARS-CoV-2 spike protein or an immunogenic fragment or immunogenic variant thereof, wherein the SARS-CoV-2 spike protein comprises at least one amino acid substitution deletion or insertion at a position selected from the list comprising N460, K444, T604, D574, K182, Y200, L518, E554, T572, Q675, D1153, E180, R21, V83, K97, H146, K147, N164, Q183, G184, N185, F186, P209, S256, G257, K356, L368I, I410, P521, N658, I666, G798, T883, S1003, A1020, E1144, D1199 and C1243 (relative to reference sequence of SEQ ID NO: 1) or wherein the SARS-CoV-2 spike protein comprises at least one amino acid substitution corresponding to N460K, K444M, K444R, K444T, V445P, E484R, F486P, K356T, D574V, T604I, Q52H, K147N, K182N, Y200C, T478Q, L518V, E554K, Q675H, T572I, D1153Y, E180V, P25S, V83A, H146Q, K147E, Q183E, I210V, L212S, V213E, D215H, H245N, G252V, G257D, G257S, G339H, L368I, N450D, F486S, F490V, N658S, G798D, S1003I, A1020S, D1199N, K97R, N164K, P209L, S256L, I666V, R21G, H146K, G184V, N185D, F186L, P521S, T883I, E1144Q, C1243F, D80Y, T547I and I410V (relative to reference sequence of SEQ ID NO: 1). In embodiments the spike protein is derived from a SARS-CoV-2 variant (e.g. from BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44) and optionally comprises a stabilizing mutation.

The term "antigenic peptide or protein from a SARS-CoV-2 spike protein" herein means (i) an antigen that is a SARS-CoV-2 spike protein having amino acid sequence of the antigenic peptide or protein (or a fragment thereof) which is identical to a SARS-CoV-2 variant protein (or a fragment thereof), or (ii) an antigen that is derived from a SARS-CoV-2 spike protein having an amino acid sequence of the antigenic peptide or protein (or a fragment thereof) which is not identical to a corresponding SARS-CoV-2 variant protein (or a fragment thereof). For example, the respective SARS-CoV-2 spike protein may comprise at least one amino acid substitution, insertion or deletion selected from a SARS-CoV-2 variant and/or at least one pre-fusion stabilizing mutation.

The term "immunogenic fragment" or "immunogenic variant" herein means any fragment/variant of the corresponding SARS-CoV-2 protein that is capable of raising an immune response in a subject. The SARS-CoV-2 protein is therefore a SARS-CoV-2 antigen. Intramuscular, or intradermal administration of the RNA of the first aspect results in expression of the encoded SARS-CoV-2 spike protein in a subject.

The term "expression" as used herein refers to the production of a SARS-CoV-2 spike protein, wherein said SARS-CoV-2 spike protein is provided by a coding sequence of an RNA of the first aspect. For example, "expression" of an RNA refers to production of a protein (e.g. after administration of said RNA to a cell or a subject) via translation of the RNA into a polypeptide, e.g. into a peptide or protein that is or is derived from a SARS-CoV-2 coronavirus. The term "expression" and the term "production" may be used interchangeably herein. Further, the term "expression" preferably relates to production of a certain peptide or protein upon administration of an RNA to a cell or an organism.

In embodiments, the RNA of the invention is suitable for a SARS-CoV-2 variant vaccine.

A SARS-CoV-2 Spike protein is a type I viral fusion protein that exists as trimer on the viral surface with each monomer consisting of a Head (S1) and stem (S2). Individual precursor S polypeptides form a homotrimer and undergo glycosylation within the Golgi apparatus as well as processing to remove the signal peptide, and cleavage by a cellular protease to generate separate S1 and S2 polypeptide chains, which remain associated as S1/S2 protomers within the homotrimer and is therefore a trimer of heterodimers. The S1 domain of the spike glycoprotein includes the receptor binding domain (RBD) that engages (most likely) with the angiotensin-converting enzyme 2 receptors and mediates viral fusion into the host cell, an N-terminal domain that may make initial contact with target cells, and 2 subdomains, all of which are susceptible to neutralizing antibodies. S2 domain consists of a six helix bundle fusion core involved in membrane fusion with the host endosomal membrane and is also a target for neutralization. The S2 subunit further comprises two heptad-repeat sequences (HR1 and HR2) and a central helix typical of fusion glycoproteins, a transmembrane domain, and the cytosolic tail domain.

In the context of the invention, any Spike protein that is selected from or is derived from a SARS-CoV-2 variant and comprises least one amino acid substitution, deletion or insertion when compared to SEQ ID NO:1 may be used and may be suitably encoded by the RNA of the first aspect. It is further in the scope of the underlying invention, that the at least one antigenic peptide or protein may comprise or consist of a synthetically engineered or an artificial SARS-CoV-2 spike protein. The term "synthetically engineered" SARS-CoV-2 spike protein, or the term "artificial SARS-CoV-2 spike protein" or the term "recombinant" SARS-CoV-2 spike protein relates to a protein that does not occur in nature. Accordingly, an "artificial SARS-CoV-2 spike protein" or a "synthetically engineered SARS-CoV-2 spike protein" or the term "recombinant" SARS-CoV-2 spike protein may, for example, differ in at least one amino acid compared to a naturally occurring SARS-CoV-2 spike protein (e.g., comprising one or more heterologous/introduced amino acids as compared to a naturally occurring SARS-CoV-2 spike protein), and/or may comprise an additional heterologous peptide or protein element, and/or may be N-terminally or C-terminally extended or truncated.

In the following, preferred antigenic peptide or protein sequences that are provided by the RNA of the invention are described in detail.

It should be noted that where reference is made to amino acid (aa) residues and their position in a SARS-CoV-2 spike protein (S), any numbering used herein—unless stated otherwise—relates to the position of the respective amino acid residue in a corresponding spike protein (S) of the original SARS-CoV-2 coronavirus isolate EPI_ISL_402128 according to SEQ ID NO: 1. Respective amino acid positions are, throughout the disclosure, exemplarily indicated for spike protein (S) of the original SARS-CoV-2 coronavirus isolate EPI_ISL_402128 (SEQ ID NO: 1).

Protein annotation as used herein relates to SEQ ID NO: 1 as a reference protein. The full-length spike protein (S) of the original SARS-CoV-2 coronavirus reference protein has 1273 amino acid residues, and comprises the following elements:

secretory signal peptide: amino acid position aa 1 to aa 15,
 spike protein fragment S1: amino acid position aa 1 to aa 681,
 S1-N-Terminal Domain (S1-NTD) amino acid position aa 13 to aa 303,
 receptor binding domain (RBD): amino acid position aa 319 to aa 541,
 critical neutralisation domain (CND): amino acid position aa 329 to aa 529,
 spike protein fragment S2: amino acid position aa 682 to aa 1273,
 transmembrane domain (TM) amino acid position aa 1212 to aa 1273,
 transmembrane domain (TMflex) amino acid position aa 1148 to aa 1273,
 Furine cleavage site region (S1/S2) amino acid position aa 681 to aa 685.

It should be noted that variation on an amino acid level naturally occurs between spike proteins derived from different SARS-CoV-2 isolates or SARS-CoV-2 variants. In the context of the invention, such amino acid variations can be applied to antigenic peptide or protein derived from a spike protein as described herein. Suitably, the amino acid variations or mutations are selected in a way to (1) induce an immune response against the SARS-CoV-2 virus variant the substitution/mutation is derived from and/or (2) to produce an antigenic peptide or protein that is desirable for inducing an immune response (e.g., an antigenic peptide or protein derived from a spike protein and that is in a pre-fusion form).

In embodiments, the RNA of the invention comprises at least one coding sequence encoding at least one SARS-CoV-2 spike protein, or an immunogenic fragment or immunogenic variant thereof, wherein the SARS-CoV-2 spike protein comprises at least one amino acid substitution, deletion, or insertion selected from a SARS-CoV-2 variant.

In that context, the term "at least one amino acid substitution, deletion, or insertion selected from a SARS-CoV-2 variant" herein means at least one amino acid position in the SARS-CoV-2 spike protein (or fragment thereof) that is different to the original SARS-CoV-2 spike protein (according to the SEQ ID NO: 1 reference strain).

In embodiments, the SARS-CoV-2 variant is selected from or is derived from the following SARS-CoV-2 lineages: BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44.

In preferred embodiments, the SARS-CoV-2 variant is selected from or derived from the following SARS-CoV-2 lineages: BQ.1.1 and XBB.1; or BQ.1.1, XBB.1 and XBB.1.5.

In preferred embodiments, the SARS-CoV-2 variant is selected from or derived from the following SARS-CoV-2 lineages: BQ.1.1 and XBB.1.16; BQ.1.1 and CH.1.1; BQ.1.1, XBB.1.5 and XBB.1.16; BQ.1.1, XBB.1.5 and CH.1.1.

In embodiments, the SARS-CoV-2 variant is selected from or derived from the following SARS-CoV-2 lineages: EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and XBB.1.5.44.

In a preferred embodiment, the SARS-CoV-2 variant is selected from or derived from SARS-CoV-2 lineage XBB.1.5.

Accordingly, each spike protein provided herein and contemplated as suitable antigen in the context of the invention may have one or more of the following amino acid variations or mutations (amino acid positions according to reference SEQ ID NO: 1) as provided in List 1 and List 2. The variations or mutations provided below are derived from new emerging SARS-CoV-2 virus variants, and may be integrated into the spike protein that is encoded by the RNA of the invention:

List 1: Amino Acid Positions for Substitutions, Deletions and/or Insertions

N460, K444, T604, D574, K182, Y200, L518, E554, T572, Q675, D1153, E180, R21, V83, K97, H146, K147, N164, Q183, G184, N185, F186, P209, S256, G257, K356,

L368, I410, P521, N658, I666, G798, T883, S1003, A1020, E1144, D1199 and C1243 (relative to the sequence of SEQ ID NO: 1).

List 2: Amino Acid Substitutions Deletions or Insertions

N460K, K444M, K444R, K444T, V445P, E484R, F486P, K356T, D574V, T604I, Q52H, K147N, K182N, Y200C, T478Q, L518V, E554K, Q675H, T572I, D1153Y, E180V, P25S, V83A, H146Q, K147E, Q183E, I210V, L212S, V213E, D215H, H245N, G252V, G257D, G257S, G339H, L368I, N450D, F486S, F490V, N658S, G798D, S1003I, A1020S, D1199N, K97R, N164K, P209L, S256L, I666V, R21G, H146K, G184V, N185D, F186L, P521S, T883I, E1144Q, C1243F, D80Y, T547I, I410V (relative to the sequence of SEQ ID NO: 1).

In embodiments, there is provided a RNA comprising at least one coding sequence encoding at least one SARS-CoV-2 spike protein or an immunogenic fragment or immunogenic variant thereof, wherein the SARS-CoV-2 spike protein comprises at least one amino acid substitution, deletion or insertion, wherein the at least one amino acid substitution, deletion or insertion is located at a position selected from the group comprising N460, K444, T604, D574, K182, Y200, L518, E554, T572, Q675, D1153, E180, R21, V83, K97, H146, K147, N164, Q183, G184, N185, F186, P209, S256, G257, K356, L368, I410, P521, N658, I666, G798, T883, S1003, A1020, E1144, D1199 and C1243, relative to the sequence of SEQ ID NO: 1.

In embodiments, the RNA comprises a coding sequence encoding a SARS-CoV-2 spike protein comprises at least the amino acid substitutions, deletions or insertions at the positions corresponding to
N460 and K444,
N460 and F486,
N460 and F490,
K444 and L452,
N460, S486, F490,
E180, T478, F486,
N460, V83, H146, Q183, L368, or
N460, V83, H146, Q183, G257, L368,
relative to the sequence of SEQ ID NO: 1.

In a further embodiment, the RNA comprises a coding sequence encoding a SARS-CoV-2 spike protein comprising at least 2, 3, 4, 5, 6, 7, 8, 9, 10, 11, 12, 13, 14, or 15 amino acid substitutions, deletions or insertions at the position corresponding to: N460, K444, T604, D574, K182, Y200, L518, E554, T572, Q675, D1153, E180, R21, V83, K97, H146, K147, N164, Q183, G184, N185, F186, P209, S256, G257, K356, L368, I410, P521, N658, I666, G798, T883, S1003, A1020, E1144, D1199 and C1243, relative to the sequence of SEQ ID NO: 1.

In embodiments there is provided a RNA comprising at least one coding sequence encoding at least one SARS-CoV-2 spike protein or an immunogenic fragment or immunogenic variant thereof, wherein the SARS-CoV-2 spike protein comprises at least one amino acid substitution corresponding to N460K, K444M, K444R, K444T, V445P, E484R, F486P, K356T, D574V, T604I, Q52H, K147N, K182N, Y200C, T478Q, L518V, E554K, Q675H, T572I, D1153Y, E180V, P25S, V83A, H146Q, K147E, Q183E, I210V, L212S, V213E, D215H, H245N, G252V, G257D, G257S, G339H, L368, N450D, F486S, F490V, N658S, G798D, S1003I, A1020S, D1199N, K97R, N164K, P209L, S256L, I666V, R21G, H146K, G184V, N185D, F186L, P521S, T883I, E1144Q, C1243F, D80Y, T547I and I410V, relative to the sequence of SEQ ID NO: 1.

In a preferred embodiment the RNA comprises at least one coding sequence encoding at least one SARS-CoV-2 spike protein or an immunogenic fragment or immunogenic variant thereof, wherein the SARS-CoV-2 spike protein comprises at least the amino acid substitution F486P, relative to the sequence of SEQ ID NO: 1.

In a further embodiment, the RNA comprises a coding sequence encoding a SARS-CoV-2 spike protein comprising, at least 2, 3, 4, 5, 6, 7, 8, 9, 10, 11, 12, 13, 14, 15, 16, 17, 18, 19, 20, or 21, 22, or 23 amino acid substitutions corresponding to: N460K, K444M, K444R, K444T, V445P, E484R, F486P, K356T, D574V, T604I, Q52H, K147N, K182N, Y200C, T478Q, L518V, E554K, Q675H, T572I, D1153Y, E180V, P25S, V83A, H146Q, K147E, Q183E, I210V, L212S, V213E, D215H, H245N, G252V, G257D, G257S, G339H, L368I, N450D, F486S, F490V, N658S, G798D, S1003I, A1020S, D1199N, K97R, N164K, P209L, S256L, I666V, R21G, H146K, G184V, N185D, F186L, P521S, T883I, E1144Q, C1243F, D80Y, T547I and I410V, relative to the sequence of SEQ ID NO: 1.

In preferred embodiments, the RNA comprises a coding sequence encoding a SARS-CoV-2 spike protein comprising at least the amino acid substitutions corresponding to
N460K and K444T,
N460K and K444M,
N460K and F486P,
N460K and E180V,
N460K and D215H,
N460K and P521S,
N460K and D80Y,
N460K and G184V,
N460K and N185D,
N460K and T883I,
N460K and E1144Q, P209L and S256L,
N164K and N460K,
K356T and I666V,
K356T and N460K,
N460K and I666V,
R21G and F186L,
I410V and P521 S,
N460K, E180V, T478R and F486P,
N460K, K444T and L452R,
K356T, N460K and I666V,
N460K, D215G and Q613H,
N460K, V445P, V83A, H146Q, Q183E, V213E, G252V, G339H, L368I, and F486S,
V83A, H146Q, Q183E, V213E, G252V, G339H, L368I, V445P, N460K and F486P, relative to the sequence of SEQ ID NO: 1.

In preferred embodiments, the RNA comprising at least one coding sequence encoding at least one SARS-CoV-2 spike protein, wherein said SARS-CoV-2 spike protein is at least 95% identical to the amino acid sequence of SEQ ID NO: 162 and comprises the following amino acid substitutions or deletions relative to SEQ ID NO: 1: K986P, V987P, T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, N764K, D796Y, Q954H and N969K.

In preferred embodiments, the SARS-CoV-2 spike protein is at least 98% identical to the amino acid sequence of SEQ ID NO: 162.

In preferred embodiments, the SARS-CoV-2 spike protein is 100% identical to the amino acid sequence of SEQ ID NO: 162.

In preferred embodiments, the at least one coding sequence is at least about 85% identical to the nucleic acid sequence of SEQ ID NO: 168.

In preferred embodiments, the at least one coding sequence is at least about 90% identical to the nucleic acid sequence of SEQ ID NO: 168.

In preferred embodiments, the RNA comprises at least one heterologous 5'-UTR and/or at least one heterologous 3'-UTR.

In preferred embodiments, the RNA comprises at least one heterologous 5'-UTR sequence of SEQ ID NO: 8 or 10, or at least one heterologous 5'-UTR sequence of SEQ ID NO: 12 or 14, or at least one heterologous 5'-UTR sequence of SEQ ID NO: 4 or 6.

In preferred embodiments, the RNA is a mRNA. In additional preferred embodiments, the RNA comprises a 1-methylpseudouridine substitution.

Accordingly, each spike protein provided herein and contemplated as suitable antigen in the context of the invention may have one or more of the following amino acid variations or mutations (amino acid positions according to reference SEQ ID NO: 1) as provided in List 3 and List 4. The variations or mutations provided below are derived from new emerging SARS-CoV-2 virus variants, and may be integrated into the spike protein that is encoded by the RNA of the invention:

List 3: Further Amino Acid Positions for Substitutions Deletions and/or Insertions L5, L8, P9, S12, S13, L18, T19, T20, L24, P25, P26, A27, H49, Q52, A67, H69, V70, G75, T76, D80, T95, V126, C136, D138, L141, G142, V143, Y144, Y145, ins145, W152, M153, E154, E156, F157, R158, R190, I210, N211, L212, V213, R214, ins214, D215, A222, Q239, E241, L242, A243, L244, H245, R246, S247, Y248, L249, T250, P251, G252, D253, S254, W258, Q321, G339, V341, R346, A348, N354, R357, S359, V367, S371, S373, S375, T376, K378, P384, R403, D405, R408, Q409, Q414, K417, A435, N437, N439, N440, V445, G446, G447, Y449, N450, L452, Y453, L455, F456, K458, I472, A475, G476, S477, T478, V483, E484, G485, F486, N487, F490, Q493, S494, G496, Q498, P499, T500, N501, G502, V503, G504, Y505, Q506, Y508, H519, A522, T547, K558, A570, Q613, D614, H655, G669, Q677, N679, P681, R682, R683, A684, R685, I692, A701, T716, T732, T748, N764, G769, D796, A831, A845, N856, T859, F888, A899, D936, S939, S940, S943, Q949, D950, Q954, Q957, N969, L981, S982, T1027, V1040, Q1071, E1092, H1101, D1118, S1147, V1176, N1187, M1229, C1254, or P1263 (relative to the sequence of SEQ ID NO: 1).

List 4: Further Amino Acid Substitutions Deletions or Insertions

L5F, L8V, P9L, S12F, S13I, L18F, T19I, T19R, T20I, T20N, L24del, P25del, P26del, P26S, A27S, H49Y, Q52R, A67V, H69del, V70del, V70F, G75V, T76I, D80A, T95I, V126A, C136F, D138Y, L141del, G142D, G142del, V143del, Y144del, Y144S, Y144T, Y144F, Y145del, Y145H, Y145N, ins145N, Y145S, Y145D, W152C, W152L, W152R, M153T, E154K, E156G, F157del, F157L, R158del, R190S, I210T, N211del, L212del, L212I, V213G, R214A, ins214EPE, ins214TDR, D215G, A222V, Q239K, E241del, L242del, A243del, L244del, H245Y, R246del, R246I, S247del, Y248del, L249del, T250del, P251del, G252del, D253G, D253N, S254F, W258L, Q321L, Q321S, G339D, V341I, R346K, R346S, R346T, A348T, N354D, R357S, S359N, V367F, S371F, S371L, S373P, S375F, T376A, K378R, K378S, P384L, R403K, D405N, R408I, R408S, Q409E, Q414K, K417N, K417T, A435S, N437S, N439K, N440K, V445A, V445F, V445I, G446A, G446S, G446V, G447V, Y449H, N450K, L452M, L452Q, L452R, Y453F, L455F, F456A, F456K, F456L, F456V, K458N, K458R, I472V, A475S, A475V, G476A, G476S, S477G, S477I, S477N, S477R, S477T, T478A, T478I, T478K, T478R, V483A, E484A, E484D, E484K, E484P, E484Q, G485R, G485S, F486I, F486L, F486V, N487I, F490L, F490S, F490Y, Q493K, Q493L, Q493R, S494A, S494L, S494P, G496S, Q498R, P499H, P499L, P499S, T500I, N501S, N501T, N501Y, G502V, V503F, V503I, G504D, Y505H, Y505W, Q506H, Q506K, Y508H, H519P, A522S, T547K, K558N, A570D, Q613H, D614G, H655Y, G669S, Q677H, N679K, P681H, P681R, R682del, R683del, A684del, R685del, I692V, A701V, T716I, T732A, T748K, N764K, G769V, D796H, D796Y, A831V, A845S, N856K, T859N, F888L, A899S, D936N, S939F, S940F, S943P, Q949R, D950N, Q954H, Q957R, N969K, L981F, S982A, T1027I, V1040F, Q1071H, E1092K, H1101Y, D1118H, S1147L, V1176F, N1187D, M1229I, C1254F, or P1263L (relative to the sequence of SEQ ID NO: 1).

In embodiments, the SARS-CoV-2 spike protein comprises at least one further amino acid substitution, deletion or insertion at a position corresponding to:

L5, L8, P9, S12, S13, L18, T19, T20, L24, P25, P26, A27, H49, Q52, A67, H69, V70, G75, T76, D80, T95, V126, C136, D138, G142, V143, Y144, Y145, ins145, W152, M153, E154, E156, F157, R158, R190, I210, N211, L212, V213, R214, ins214, D215, A222, Q239, E241, L242, A243, L244, H245, R246, S247, Y248, L249, T250, P251, G252, D253, S254, W258, Q321, G339, V341, R346, A348, N354, R357, S359, V367, S371, S373, S375, T376, K378, P384, R403, D405, R408, Q409, Q414, K417, A435, N437, N439, N440, V445, G446, G447, Y449, N450, L452, Y453, L455, F456, K458, I472, A475, G476, S477, T478, V483, E484, G485, F486, N487, F490, Q493, S494, G496, Q498, P499, T500, N501, G502, V503, G504, Y505, Q506, Y508, H519, A522, T547, K558, A570, Q613, D614, H655, G669, Q677, N679, P681, R682, R683, A684, R685, I692, A701, T716, T732, T748, N764, G769, D796, A831, A845, N856, T859, F888, A899, D936, S939, S940, S943, Q949, D950, Q954, Q957, N969, L981, S982, T1027, V1040, Q1071, E1092, H1101, D1118, S1147, V1176, N1187, M1229, C1254, P1263, relative to the sequence of SEQ ID NO: 1.

In embodiments, amino acid substitutions, deletions or insertions are at positions corresponding to E346, L452, E484, K417, G446, S477, F490, N501, D614, or P681.

In embodiments, the RNA comprises a coding sequence encoding a SARS-CoV-2 spike protein comprises at least the amino acid substitutions, deletions or insertions at the positions corresponding to:

N460 and F490,
N460 and E180,
N460 and D215,
N460 and P521,
N460 and D80,
N460 and G184,
N460 and N185,
N460 and T883,
N460 and E1144,
N460 and K182,
N460 and Y200,
N460 and Q615,
N460 and L518,
N460 and E554,
N460 and T572,
N460, R346, and F490,
N460, K182, R346, and F490, N460, Y200, R346, and F490,
N460, Q615, R346, and F490,
N460, L518, R346, and F490,
N460, E554, R346, and F490,
N460, T572, R346, and F490,
N460, R346, F490 and Y144,
N460, K182, R346, F490 and Y144,
N460, Y200, R346, F490 and Y144,
N460, Q615, R346, F490 and Y144,
N460, L518, R346, F490 and Y144,
N460, E554, R346, F490 and Y144,
N460, T572, R346, F490 and Y144,
N460 and D614,
N460, K182 and D614,
N460, Y200 and D614,
N460, Q615 and D614,
N460, L518 and D614,
N460, E554 and D614,
N460, T572 and D614,
N460 and F490,
N460, K182 and F490,
N460, Y200 and F490,
N460, Q615 and F490,
N460, L518 and F490,
N460, E554 and F490,
N460, T572 and F490,
N460, D614, and L452,
N460, K444, and R346,
N460, K444, and Y144,
T604 and L452,
K444, A1020, and D614,
N460, F486 and F490,
N460, F486, R346 and F490,
N460, F486, R346, F490 and Y144,
N460, K182, F486, R346, F490 and Y144,
N460, Y200, F486, R346, F490 and Y144,
N460, Q615, F486, R346, F490 and Y144,
N460, L518, F486, R346, F490 and Y144,
N460, E554, F486, R346, F490 and Y144,
N460, T572, F486, R346, F490 and Y144,
N460, F486, and D614,
K182 and F490,
K182 and D614,
K182 and Y144,
K182 and F486,
K182 and R346,
Y200 and F490,
Y200 and D614,
Y200 and Y144,
Y200 and F486,
Y200 and R346, P209 and L452,
P209 and D614,
P209 and Y144,
Q615 and F490,
Q615 and D614,
Q615 and Y144,
Q615 and F486,
Q615 and R346,
L518 and F490,
L518 and D614,
L518 and Y144,
L518 and F486,
L518 and R346,
E554 and F490,
E554 and D614,
E554 and Y144,
E554 and F486,
E554 and R346,
T572 and F490,
T572 and D614,
T572 and Y144,
T572 and F486,
T572 and R346,
P209, L452 and Y144,
S256 and L452,
S256 and D164,
S256 and Y144,
K182, D614 and F490,
K182, D614 and Y144,
K182, D614 and F486,
K182, D614 and R346,
Y200, D614 and F490,
Y200, D614 and Y144,
Y200, D614 and F486,
Y200, D614 and R346,
Q615, D614 and F490,
Q615, D614 and Y144,
Q615, D614 and F486,
Q615, D614 and R346,
L518, D614 and F490,
L518, D614 and Y144,
L518, D614 and F486,
L518, D614 and R346,
E554, D614 and F490,
E554, D614 and Y144,
E554, D614 and F486,
E554, D614 and R346,
T572, D614 and F490,
T572, D614 and Y144,
T572, D614 and F486,
T572, D614 and R346,
S256, L452 and Y144,
P209, S256 and L452,
P209, S256 and D164,
P209, S256 and Y144,
P209, S256, L452 and Y144,
K356 and F490,
K356 and R346,
K356 and D614,
K356, F490 and R346,
K356, F490, R346 and D614,
I666 and F490,
I666 and R346,
I666 and D614,
I666, F490 and R346,
I666, F490, R346 and D614,
N460, I666 and F490,
N460, I666 and R346,
N460, I666 and D614,
N460, I666, F490 and R346,
N460, I666, F490, R346 and D614,
N164 and K444,
N164 and L452,
N164 and D614,
N164, K444 and L452,
N164, K444, L452 and D614,
N460, N164 and K444,
N460, N164 and L452,
N460, N164 and D614,
N460, N164, K444 and L452,
N460, N164, K444, L452 and D614
R21 and F186,
I410 and P521,
N460, D215 and Q613, D1153 and D614,
D1153 and F486,
D1153 and R346,
D1153 and L452,
D1153, D614 and F486,
D1153, D614 and R346,
D1153, D614 and L452,
D1153, D614, R346 and F486,
D1153, D614, R346 and L452,
D1153, D614, R346, F486 and L452,
relative to the sequence of SEQ ID NO: 1.

In further embodiments, the SARS-CoV-2 spike protein comprises at least one further amino acid substitution or deletion corresponding to:

L5F, L8V, P9L, S12F, S13I, L18F, T19I, T19R, T20I, T20N, L24del, P25del, P26del, P26S, A27S, H49Y, Q52R, A67V, H69del, V70del, V70F, G75V, T76I, D80A, T95I, V126A, C136F, D138Y, L141del, G142D, G142del, V143del, Y144del, Y144S, Y144T, Y144F, Y145del, Y145H, Y145N, ins145N, Y145S, Y145D, W152C, W152L, W152R, M153T, E154K, E156G, F157del, F157L, R158del, R190S, I210T, N211del, L212del, L212I, V213G, R214A, ins214EPE, ins214TDR, D215G, A222V, Q239K, E241del, L242del, A243del, L244del, H245Y, R246del, R246I, S247del, Y248del, L249del, T250del, P251del, G252del, D253G, D253N, S254F, W258L, Q321L, Q321S, G339D, V341I, R346K, R346S, R346T, A348T, N354D, R357K, S359N, V367F, S371F, S371L, S373P, S375F, T376A, K378R, K378S, P384L, R403K, D405N, R408I, R408S, Q409E, Q414K, K417N, K417T, A435S, N437S, N439K, N440K, V445A, V445F, V445I, G446A, G446S, G446V, G447V, Y449H, N450K, L452M, L452Q, L452R, Y453F, L455F, F456A, F456K, F456L, F456V, K458N, K458R, I472V, A475S, A475V, G476A, G476S, S477G, S477I, S477N, S477R, S477T, T478A, T478I, T478K, T478R, V483A, E484A, E484D, E484K, E484P, E484Q, G485R, G485S, F486I, F486L, F486V, N487I, F490L, F490S, F490Y, Q493K, Q493L, Q493R, S494A, S494L, S494P, G496S, Q498R, P499H, P499L, P499S, T500I, N501S, N501T, N501Y, G502V, V503F, V503I, G504D, Y505H, Y505W, Q506H, Q506K, Y508H, H519P, A522S, T547K, K558N, A570D, Q613H, D614G, H655Y, G669S, Q677H, N679K, P681H, P681R, R682del, R683del, A684del, R685del, I692V, A701V, T716I, T732A, T748K, N764K, G769V, D796H, D796Y, A831V, A845S, N856K, T859N, F888L, A899S, D936N, S939F, S940F, S943P, Q949R, D950N, Q954H, Q957R, N969K, L981F, S982A, T1027I, V1040F, Q1071H, E1092K, H1101Y, D1118H, S1147L, V1176F, N1187D, M1229I, C1254F, P1263L, relative to the sequence of SEQ ID NO: 1.

In embodiments, the SARS-CoV-2 spike protein comprises at least one further amino acid substitution corresponding to: R346K, R346T, 346S, K417N, K417T, L452M, L452Q, L452R, S477N, V483A, E484A, E484K, F490S, F490V, F490Y, N501Y, D614G, P681H, or P681R, relative to the sequence of SEQ ID NO: 1.

In embodiments, the SARS-CoV-2 spike protein comprises at least one further amino acid substitution corresponding to: R346K, R346T, G446S, L452M, L452Q, L452R, or F490S, relative to the sequence of SEQ ID NO: 1.

In embodiments, the RNA comprises a coding sequence encoding a SARS-CoV-2 spike protein comprising at least the amino acid substitutions or deletion corresponding to:

N460K and F490S,
N460K and E180V,
N460K and D215H,
N460K and P521S,
N460K and D80Y,
N460K and G184V,
N460K and N185D,
N460K and T883I,
N460K and E1144Q,
N460K and Q613H,
N460K and K182N,
N460K and Y200C,
N460K and Q615H,
N460K and L518V,
N460K and E554K,
N460K and T572I,
N460K, R346T and F490S,
N460K, S486P and F490S,
N460K, K182N and D614G,
N460K, Y200C and D614G,
N460K, Q615H and D614G,
N460K, L518V and D614G,
N460K, E554K and D614G,
N460K, T572I and D614G,
N460K, K182N and F490S,
N460K, Y200C and F490S,
N460K, Q615H and F490S,
N460K, L518V and F490S,
N460K, E554K and F490S,
N460K, T572I and F490S,
N460K, K182N, R346T, and F490S,
N460K, Y200C, R346T, and F490S,
N460K, Q615H, R346T, and F490S,
N460K, L518V, R346T, and F490S,
N460K, E554K, R346T, and F490S,
N460K, T572I, R346T, and F490S,
N460K, R346T, F490S and Y144del,
N460K, K182N, R346T, F490S and Y144del,
N460K, Y200C, R346T, F490S and Y144del,
N460K, Q615H, R346T, F490S and Y144del,
N460K, L518V, R346T, F490S and Y144del,
N460K, E554K, R346T, F490S and Y144del,
N460K, T572I, R346T, F490S and Y144del,
N460K, and D614G,
N460K, D614G, and L452R,
N460K, K444T, and R346T,
N460K, K444M, and Y144del,
N460K, G252V. and Y144del,
G339H and R346T,
F486S and R346T,
K182N and F490S,
K182N and D614G,
K182N and Y144del,
K182N and F486S,
K182N and R346T,
Y200C and F490S,
Y200C and D614G,
Y200C and Y144del,
Y200C and F486S,
Y200C and R346T,
F486S, D1199N, and R346T,
N658S and R346T,
T604I and L452R,
K444M, A1020S, and D614G,
V83A, H146Q, Q183E, V213E, G252V, G339H, L368I, V445P, N460K, F486S, and F490S,
N460K, D614G, and F490S,
N460K, R346T, D614G, and F490S,
N460K, R346T, F490S, D614G, and Y144del,
N460K, D614G, and L452R, N460K, K444T, D614G, and R346T,
N460K, K444M, D614G, and Y144del,
N460K, G252V, D614G, and Y144del,
N460K, K182N, F486P, R346T, F490S and Y144del,
N460K, Y200C, F486P, R346T, F490S and Y144del,
N460K, Q615H, F486P, R346T, F490S and Y144del,
N460K, L518V, F486P, R346T, F490S and Y144del,
N460K, E554K, F486P, R346T, F490S and Y144del,
N460K, T572I, F486P, R346T, F490S and Y144del,
G339H, D614G, and R346T,
F486S, D614G, and R346T,
F486S, D1199N, D614G, and R346T,
N658S, D614G, and R346T,
T604I, D614G, and L452R;
F486P and F490S,
F486P, R346T and F490S,
F486P and R346T,
F486P, D1199N, and R346T,
F486P, R346T, F490S and Y144del,
F486P and D614G,
F486P and F490S,
K182N and F490S,
K182N and D614G,
K182N and Y144del,
K182N and F486S,
K182N and R346T,
Y200C and F490S,
Y200C and D614G,
Y200C and Y144del,
Y200C and F486S,
Y200C and R346T,
E180V, T478R and F486P,
N460K, D215G and Q613H,
K182N, D614G and F490S,
K182N, D614G and Y144del,
K182N, D614G and F486S,
K182N, D614G and R346T,
Y200C, D614G and F490S,
Y200C, D614G and Y144del,
Y200C, D614G and F486S,
Y200C, D614G and R346T,
Q615H, D614G and F490S,
Q615H, D614G and Y144del,
Q615H, D614G and F486S,
Q615H, D614G and R346T,
L518V, D614G and F490S,
L518V, D614G and Y144del,
L518V, D614G and F486S,
L518V, D614G and R346T,
E554K, D614G and F490S,
E554K, D614G and Y144del,
E554K, D614G and F486S,
E554K, D614G and R346T,
T572I, D614G and F490S,
T572I, D614G and Y144del,
T572I, D614G and F486S,
T572I, D614G and R346T,
D1153Y and D614G,
D1153Y and F486S,
D1153Y and R346,
D1153Y and L452,
D1153Y, D614G and F486,
D1153Y, D614G and R346,
D1153Y, D614G and L452,
D1153Y, D614G, R346T and F486,
D1153Y, D614G, R346T and L452R,
D1153Y, D614G, R346T, F486S and L452R,
V83A, H146Q, Q183E, V213E, G252V, G339H, L368I, V445P, N460K, F486S, D614G, and F490S, or
V83A, H146Q, Q183E, V213E, G252V, G339H, L368I, V445P, N460K, F486P, and F490S, relative to the sequence of SEQ ID NO: 1.

In embodiments, the RNA comprises a coding sequence encoding a SARS-CoV-2 spike protein comprising at least the amino acid substitutions corresponding to F486P and D614G, relative to the sequence of SEQ ID NO: 1.

In further embodiments, the RNA comprises a coding sequence encoding a SARS-CoV-2 spike protein comprising at least the amino acid substitutions or deletions corresponding to:

T19I, L24del, P25del, P26del, A27S, H69del, V70del, G142D, V213G, G339D, R346T, S371F, S373P, S375F, T376A, D405N, R408S, K417N, N440K, K444T, L452R, N460K, S477N, T478K, E484A, F486V, Q498R, N501Y, Y505H, D614G, H655Y, N679K, P681H, N764K, D796Y, Q954H, N969K (BQ.1.1);

T19I, L24del, P25del, P26del, A27S, H69del, V70del, G142D, V213G, G339D, S371F, S373P, S375F, T376A, D405N, R408S, K417N, N440K, K444T, L452R, N460K, S477N, T478K, E484A, F486V, Q498R, N501Y, Y505H, D614G, H655Y, I666V, N679K, P681H, N764K, D796Y, Q954H, N969K (BQ.1.2);

T19I, L24del, P25del, P26del, A27S, H69del, V70del, G142D, Y144del, V213G, G339D, R346T, S371F, S373P, S375F, T376A, D405N, R408S, K417N, N440K, K444T, L452R, N460K, S477N, T478K, E484A, F486V, Q498R, N501Y, Y505H, D614G, H655Y, N679K, P681H, N764K, D796Y, Q954H, N969K (BQ.1.18);

T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486S, F490S, Q498R, N501Y, Y505H, D614G, H655Y, N679K, P681H, N764K, D796Y, Q954H, N969K (XBB.1);

T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, N764K, D796Y, Q954H, N969K (XBB.1.5);

T19I, L24del, P25del, P26del, A27S, V83A, G142D, E180V, Y144del, H146Q, Q183E, V213E, G252V, G339H, R346T, L368I, S371F, S373P, S375F, T376A, D405N, R408S, K417N, N440K, V445P, G446S, N460K, S477N, T478R, E484A, F486P, F490S, Q498R, N501Y, Y505H, D614G, H655Y, N679K, P681H, N764K, D796Y, Q954H, N969K (XBB.1.16);

T19I, L24del, P25del, P26del, A27S, V83A, G142D, E180V, Y144del, H146Q, Q183E, V213E, G252V, G339H, R346T, L368I, S371F, S373P, S375F, T376A, D405N, R408S, K417N, N440K, V445P, G446S, N460K, S477N, T478R, E484A, F486P, F490S, Q498R, N501Y, Y505H, T547I D614G, H655Y, N679K, P681H, N764K, D796Y, Q954H, N969K (XBB.1.16.1);

T19I, L24del, P25del, P26del, A27S, V83A, G142D, Y144del, H146Q, Q183E, V213E, D215H, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, N764K, D796Y, Q954H, N969K (XBB.1.17.1);

T19I, L24del, P25del, P26del, A27S, V83A, G142D, Y144del, H146Q, Q183E, V213E, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, N764K, D796Y, Q954H, N969K (XBB.1.22);

T19I, L24del, P25del, P26del, A27S, V83A, G142D, Y144del, H146Q, Q183E, V213E, D253G, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, P521S, D614G, H655Y, N679K, P681H, N764K, D796Y, Q954H, N969K (XBB.2.3);

T19I, L24del, P25del, P26del, A27S, D80Y, V83A, G142D, delY144, H146Q, Q183E, V213E, D253G, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, P521S, D614G, H655Y, N679K, P681H, N764K, D796Y, Q954H, N969K (XBB.2.3.1);

T19I, L24del, P25del, P26del, A27S, V83A, G142D, Y144del, H146Q, Q183E, G184V, V213E, D253G, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, P521S, D614G, H655Y, N679K, P681H, N764K, D796Y, Q954H, N969K (XBB.2.3.2);

L18F, T19R, R21G, T95I, W152L, E156G, F157del, R158del, F186L, V213G, G339D, S371F, S373P, S375F, T376A, D405N, R408S, K417N, N440K, G446D, S477N, L452R T478K, E484A, F486P, Q498R, N501Y, Y505H, D614G, P621S, H655Y, N679K, P681H, A706V N764K, D796Y, Q954H, N969K, T1117I (XAY-2);

T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, N764K, D796Y, Q954H, N969K (FD.2);

T19I, P25S, G142D, Y144del, E156G, F157del, R158del, P209L, L212S, D215H, A222V, A243del, L244del, S371F, S373P, S375F, T376A, D405N, R408S, K417N, N440K, G446S, L452M, S477N, T478K, E484A, F486P, Q498R, N501Y, Y505H, D614G, H655Y, N679K, P681H, N703I, N764K, D796Y, Q954H, N969K (XBC.1);

T19I, P25S, K97R, G142D, Y144del, E156G, F157del, R158del, P209L, L212S, D215H, A222V, A243del, L244del, S371F, S373P, S375F, T376A, D405N, R408S, K417N, N440K, G446S, S477N, T478K, E484A, F486P, Q498R, N501Y, Y505H, D614G, H655Y, N679K, P681H, N703I, N764K, D796Y, Q954H, N969K (XBC.2);

T19I, L24del, P25del, P26del, A27S, G142D, K147E, W152R, F157L, I210V, V213G, G257S, G339H, R346T, S371F, S373P, S375F, T376A, D405N, R408S, K417N, N440K, G446S, N460K, S477N, T478K, E484A, F486P, F490S, Q498R, N501Y, Y505H, D614G, H655Y, N679K, P681H, N764K, D796Y, Q954H, N969K (XBF);

T19I, L24del, P25del, P26del, A27S, G142D, M153T, N164K, V213G, H245N, G257D, G339D, S371F, S373P, S375F, T376A, D405N, R408S, K417N, N440K, K444R, N450D, L452M, N460K, S477N, T478K, E484R, Q498R, N501Y, Y505H, D614G, H655Y, N679K, P681H, N764K, D796Y, Q954H, N969K (CM.2);

T19I, L24del, P25del, P26del, A27S, G142D, K147E, W152R, F157L, I210V, V213G, G257S, G339H, R346T, K356T, S371F, S373P, S375F, T376A, D405N, R408S, K417N, N440K, G446S, N460K, S477N, T478K, E484A, F490S, Q498R, N501Y, Y505H, D614G, H655Y, N679K, P681H, N764K, D796Y, Q954H, N969K (BN.1);

T19I, L24del, P25del, P26del, A27S, H69del, V70del, G142D, V213G, G339D, S371F, S373P, S375F, T376A, D405N, R408S, K417N, N440K, L452R, S477N, T478K, E484A, F486V, Q498R, N501Y, Y505H, D614G, H655Y, N679K, P681H, N764K, D796Y, Q954H, N969K, A1020S (BF.5);

T19I, L24del, P25del, P26del, A27S, G142D, K147E, W152R, F157L, I210V, V213G, G257S, G339H, S371F, S373P, S375F, T376A, D405N, R408S, K417N, N440K, G446S, N460K, S477N, T478K, E484A, Q498R, N501Y, Y505H, D614G, H655Y, N679K, P681H, N764K, D796Y, Q954H, N969K (BA.2.75);

T19I, L24del, P25del, P26del, A27S, G142D, K147E, W152R, F157L, I210V V213G, G257S, G339H, S371F, S373P, S375F, T376A, D405N, R408S, K417N, N440K, G446S, N460K, S477N, T478K, E484A, Q498R, N501Y, Y505H, D574V, D614G, H655Y, N679K, P681H, N764K, D796Y, Q954H, N969K (BA.2.75.1);

T19I, L24del, P25del, P26del, A27S, G142D, K147E, W152R, F157L, I210V, V213G, G257S, G339H, R346T, S371F, S373P, S375F, T376A, D405N, R408S, K417N, N440K, G446S, N460K, S477N, T478K, E484A, F486S, Q498R, N501Y, Y505H, D614G, H655Y, N679K, P681H, N764K, D796Y, Q954H, N969K, D1199N (BA.2.75.2);

T19I, L24del, P25del, P26del, A27S, G142D, K147E, W152R, F157L, I210V, V213G, G257S, G339H, R346T, S371F, S373P, S375F, T376A, D405N, R408S, K417N, N440K, G446S, N460K, S477N, T478K, E484A, F486S, Q498R, N501Y, Y505H, D614G, H655Y, N679K, P681H, N764K, D796Y, Q954H, N969K (BM1.1);

T19I, L24del, P25del, P26del, A27S, G142D, K147E, W152R, F157L, I210V, V213G, G257S, G339H, R346T, S371F, S373P, S375F, T376A, D405N, R408S, K417N, N440K, G446S, N460K, S477N, T478K, E484A, F486S, F490S, Q498R, N501Y, Y505H, D614G, H655Y, N679K, P681H, N764K, D796Y, Q954H, N969K (BM.1.1.1);

T19I, L24del, P25del, P26del, A27S, G142D, K147E, W152R, F157L, I210V, V213G, G257S, G339H, R346T, S371F, S373P, S375F, T376A, D405N, R408S, K417N, N440K, G446S, L452R, N460K, S477N, T478K, E484A, F486S, Q498R, N501Y, Y505H, T604I, D614G, H655Y, N679K, P681H, N764K, D796Y, Q954H, N969K, D1199N (CA.1);

T19I, L24del, P25del, P26del, A27S, H69del, V70del, G142D, Y144del, V213G, G339D, S371F, S373P, S375F, T376A, D405N, R408S, K417N, N440K, K444M, L452R, N460K, S477N, T478K, E484A, F486V, Q498R, N501Y, Y505H, D614G, H655Y, N679K, P681H, N764K, D796Y, Q954H, N969K (BU.1);

T19I, L24del, P25del, P26del, A27S, V83A, G142D, Y144del, H146Q, Q183E, V213E, G339H, R346T, L368I, S371F, S373P, S375F, T376A, D405N, R408S, K417N, N440K, V445P, G446S, S477N, T478K, V483A, E484A, F490V, Q493R, Q498R, N501Y, Y505H, D614G, H655Y, N679K, P681H, N764K, D796Y, G798D, Q954H, N969K, S1003I (BJ.1); or T19I, L24del, P25del, P26del, A27S, V83A, G142D, Y144del, H146Q, Q183E, V213E, G339H, R346T, L368I, D405N, N440K, V445P, G446S, S477N, T478K, V483A, E484A, F490V, Q493R, Q498R, N501Y, Y505H, D614G, H655Y, N679K, P681H, N764K, D796Y, G798D, Q954H, N969K, S1003I (BJ.1.v1);

T19I, L24del, P25del, P26del, A27S, H69del, V70del, G142D, V213G, R346T, G339D, S371F, S373P, S375F, T376A, D405N, R408S, K417N, N440K, L452R, S477N, T478K, E484A, F486V, Q498R, N501Y, Y505H, D614G, H655Y, N679K, P681H, N764K, D796Y, Q954H, N969K (BF.7);

T19I, L24del, P25del, P26del, A27S, H69del, V70del, G142D, V213G, R346T, G339D, S371F, S373P, S375F, T376A, D405N, R408S, K417N, N440K, L452R, S477N, T478K, E484A, F486V, Q498R, N501Y, Y505H, D614G, H655Y, N679K, P681H, N764K, D796Y, Q954H, N969K, C1243F (BF.7.14);

T19I, L24del, P25del, P26del, A27S, G142D, K147E, W152R, F157L, I210V, V213G, G257S, G339H, R346T S371F, S373P, S375F, T376A, D405N, R408S, K417N, N440K, K444T, G446S, N460K, L452R, S477N, T478K, E484A, F486S, Q498R, N501Y, Y505H, D614G, H655Y, N679K, P681H, N764K, D796Y, Q954H, N969K (CH.1.1);

T19I, L24del, P25del, P26del, A27S, G142D, K147E, W152R, F157L, N185D, I210V V213G, G257S, G339H, R346T S371F, S373P, S375F, T376A, D405N, R408S, K417N, N440K, K444T, G446S, N460K, L452R, S477N, T478K, E484A, F486S Q493R, Q498R, N501Y, Y505H, D614G, H655Y, N679K, P681H, N764K, D796Y, Q954H, N969K (CH.1.1.1);

T19I, L24del, P25del, P26del, A27S, G142D, K147E, W152R, F157L, I210V, V213G, G257S, G339H, R346T S371F, S373P, S375F, T376A, D405N, R408S, K417N, N440K, K444T, G446S, N460K, L452R, S477N, T478K, E484A, F486S Q493R, Q498R, N501Y, Y505H, D614G, H655Y, N679K, P681H, N764K, D796Y, T883I, Q954H, N969K (CH.1.1.2);

T19I, L24del, L25del, P26del, A27S, H69del, V70del, G142D, Y144del, V213G, D253G, G339D, R346T, S371F, S373P, S375F, T376A, D405N, R408S, K417N, N440K, K444T, L452R, N460K, S477N, T478K, E484A, F486V, Q498R, N501Y, Y505H, D614G, H655Y, N679K, P681H, N764K, D796Y, Q954H, N969K, E1144Q (DU1);

T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, Q613H, D614G, H655Y, N679K, P681H, N764K, D796Y, Q954H, N969K (EG1);

T19I, L24del, P25del, P26del, A27S, V83A, G142D, Y144del, H146Q, Q183E, V213E, G252V, G339H, R346T, L368I, S371F, S373P, S375F, T376A, D405N, R408S, I410V, K417N, N440K, V445P, G446S, N460K, S477N, T478K, E484A, F486P, F490S, Q498R, N501Y, Y505H, P521S, D614G, H655Y, N679K, P681H, N764K, D796Y, Q954H, N969K (EU.1.1);

T19I, L24del, P25del, P26del, A27S, G142D, K147E, W152R, F157L, I210V, V213G, D215G, G257S, G339H, R346T S371F, S373P, S375F, T376A, D405N, R408S, K417N, N440K, K444T, G446S, N460K, L452R, S477N, T478K, E484A, F486S, Q498R, N501Y, Y505H, Q613H, D614G, H655Y, N679K, P681H, N764K, D796Y, Q954H, N969K (FK.1);

T19I, P25S, G142D, Y144del, E156G, F157del, R158del, P209L, L212S, D215H, A222V, A243del, L244del, S256L, R346S, S371F, S373P, S375F, T376A, D405N, R408S, K417N, N440K, G446S, L452R, S477N, T478K, E484A, F486P, Q498R, N501Y, Y505H, D614G, H655Y, N679K, P681H, N703I, N764K, D796Y, Q954H, N969K (XBC.1.6);

T19I, L24del, P25del, P26del, A27S, Q52H, V83A, G142D, Y144del, H146Q, Q183E, V213E, G252V, G339H, R346T, L368I, S371F, S373P, S375F, T376A, D405N, R408S, K417N, N440K, V445P, G446S, F456L, N460K, S477N, T478K, E484A, F486P, F490S, Q498R, N501Y, Y505H, D614G, H655Y, N679K, P681H, N764K, D796Y, Q954H, N969K (EG.5.1);

T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, F456L, N460K, S477N, T478K, E484A, F486P, F490S, Q498R, N501Y, Y505H, D614G, H655Y, N679K, P681H, N764K, D796Y, Q954H, N969K (EG.5/FE.1/XBB.1.18.1.1);

T19I, L24del, P25del, P26del, A27S, V83A, G142D, Y144del, H146Q, K182N, Q183E, V213E, D253G, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, P521S, D614G, H655Y, N679K, P681H, N764K, D796Y, Q954H, N969K (XBB.2.3.3);

T19I, L24del, P25del, P26del, A27S, V83A, G142D, Y144del, H146Q, Q183E, V213E, D253G, G339H, R346T, L368I, S371F, S373P, S375F, T376A, D405N, R408S, K417N, N440K, V445P, G446S, N460K, S477N, T478Q, E484A, F486P, F490S, Q498R, N501Y, Y505H, P521S, D614G, H655Y, N679K, P681H, N764K, D796Y, Q954H, N969K (XBB.2.4);

T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, L518V, D614G, H655Y, N679K, P681H, N764K, D796Y, Q954H, N969K (GB.1);

T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, A701V, N764K, D796Y, Q954H, N969K (FL.1/FL.1.3);

T19I, L24del, P25del, P26del, A27S, G142D, M153T, N164K, V213G, H245N, G257D, G339H, R346T, S371F, S373P, S375F, T376A, D405N, R408S, K417N, N440K, K444R, G446S, N450D, L452M, N460K, S477N, T478K, E484R, F486P, Q498R, N501Y, Y505H, D614G, H655Y, N679K, P681H, N764K, D796Y, Q954H, N969K (FV.1);

T19I, L24del, P25del, P26del, A27S, V83A, G142D, E180V, Y144del, H146Q, Q183E, V213E, G252V, G339H, R346T, L368I, S371F, S373P, S375F, T376A, D405N, R408S, K417N, N440K, V445P, G446S, F456L, N460K, S477N, T478R, E484A, F486P, F490S, Q498R, N501Y, Y505H, D614G, H655Y, N679K, P681H, N764K, D796Y, Q954H, N969K (XBB.1.16.6);

T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, E554K, D614G, H655Y, N679K, P681H, N764K, D796Y, Q954H, N969K (XBB.1.19.1);

T19I, L24del, P25del, P26del, A27S, V83A, G142D, Y144del, H146Q, Q183E, Y200C, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, N764K, D796Y, Q954H, N969K (XBB.1.22.1);

T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, Q675H, N764K, D796Y, Q954H, N969K (EL.1);

L18F, T19R, R21G, T95I, G142D, W152L, E156G, F157del, R158del, F186L, V213G, D253G, G339D, R346T, S371F, S373P, S375F, T376A, D405N, R408S, K417N, N440K, G446D, S477N, L452R T478K, E484A, F486P, Q498R, N501Y, Y505H, D614G, P621S, H655Y, N679K, P681H, A706V N764K, D796Y, Q954H, N969K, D1153Y, T1117I (XAY-1.1.1);

T19I, L24del, P25del, P26del, A27S, V83A, G142D, Y144del, H146Q, Q183E, V213E, G252V, G339H, R346T, K356T, L368I, S371F, S373P, S375F, T376A, D405N, R408S, K417N, N440K, V445P, G446S, N460K, S477N, T478K, E484A, F486P, F490S, Q498R, N501Y, Y505H, T572I, D614G, H655Y, N679K, P681H, N764K, D796Y, Q954H, N969K (XBB.1.5.44);

relative to the sequence of SEQ ID NO: 1.

In preferred embodiments, the RNA comprises a coding sequence encoding a SARS-CoV-2 spike protein derived from a SARS-CoV-2 variant selected from BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44.

In embodiments, the RNA comprises a coding sequence encoding a SARS-CoV-2 spike protein derived from a SARS-CoV-2 variant BQ.1.1, or an immunogenic fragment or immunogenic variant thereof.

In embodiments, the RNA comprises a coding sequence encoding a SARS-CoV-2 spike protein derived from a SARS-CoV-2 variant XBB.1, or an immunogenic fragment or immunogenic variant thereof.

In preferred embodiments, the RNA comprises a coding sequence encoding a SARS-CoV-2 spike protein derived from a SARS-CoV-2 variant XBB.1.5, or an immunogenic fragment or immunogenic variant thereof.

In embodiments, the RNA comprises a coding sequence encoding a SARS-CoV-2 spike protein derived from a SARS-CoV-2 variant XBB.1.16, or an immunogenic fragment or immunogenic variant thereof.

In embodiments, the RNA comprises a coding sequence encoding a SARS-CoV-2 spike protein derived from a SARS-CoV-2 variant XBB.1.16.1, or an immunogenic fragment or immunogenic variant thereof.

In embodiments, the RNA comprises a coding sequence encoding a SARS-CoV-2 spike protein derived from a SARS-CoV-2 variant XBB.1.19.1, or an immunogenic fragment or immunogenic variant thereof.

In embodiments, the RNA comprises a coding sequence encoding a SARS-CoV-2 spike protein derived from a SARS-CoV-2 variant EG.5.1, or an immunogenic fragment or immunogenic variant thereof.

In embodiments, the RNA comprises a coding sequence encoding a SARS-CoV-2 spike protein derived from a SARS-CoV-2 variant CH.1.1, or an immunogenic fragment or immunogenic variant thereof.

In embodiments, the RNA comprises a coding sequence encoding a SARS-CoV-2 spike protein derived from a SARS-CoV-2 variant FK.1, or an immunogenic fragment or immunogenic variant thereof.

In embodiments, the SARS-CoV-2 spike protein comprises an amino acid substitution at a position located in the RBD domain (amino acid position aa 319 to aa 541; amino acid positions according to reference SEQ ID NO: 1) or the CND domain (amino acid position aa 329 to aa 529; amino acid positions according to reference SEQ ID NO: 1). Without wishing to be bound to theory, amino acid substitutions or mutations in the CND domain may help new emerging SARS-CoV-2 variants to evade antibody detection of some types of antibodies induced in subjects vaccinated with first generation vaccines (designed against the original SARS-CoV-2 strain) or induced in subjects after infection with the original SARS-CoV-2 strain.

Accordingly, in embodiments, the first aspect of the invention relates to an RNA comprising at least one coding sequence encoding at least one antigenic peptide or protein from a SARS-CoV-2 spike protein or an immunogenic fragment or immunogenic variant thereof, wherein the RNA comprises at least one heterologous untranslated region (UTR) and wherein the SARS-CoV-2 spike protein comprises at least one amino acid substitution at position located in the RBD domain (amino acid position aa 319 to aa 541; amino acid positions according to reference SEQ ID NO: 1) or the CND domain (amino acid position aa 329 to aa 529 amino acid positions according to reference SEQ ID NO: 1).

In embodiments, the SARS-CoV-2 spike protein comprises an amino acid substitution, insertion or deletion in at least one of the following positions: L368, K444, N460, (amino acid positions according to reference SEQ ID NO: 1).

In embodiments, the SARS-CoV-2 spike protein comprises an amino acid substitution selected from: G339H, L368I, K444M, K444T, V445P, N460K, F486S, or F490V (according to reference SEQ ID NO: 1).

In preferred embodiments, the SARS-CoV-2 spike protein comprises an amino acid substitution at position N460, wherein the amino acids N460 is substituted with a different amino acid (amino acid positions according to reference SEQ ID NO: 1).

Without wishing to be bound to theory, an amino acid substitution at position N460 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in N460 occurs near the top of the coronavirus spike in a region relevant for ACE2 receptor interaction, where it may alter the shape of the protein, which may help to evade some types of coronavirus antibodies. Such SARS-CoV-2 are called SARS-CoV-2 N460 variants throughout the present invention and include e.g. Omicron BA.2.75, BA.2.75.1, BA.2.75.2, BM.1.1, BM.1.1.1, CA.1, BQ.1.1, BU.1, XBB.1, XBB.1.5, XBB.1.16, XBB.1.16.1, XBB.1.17.1, XBB.1.22, XBB.2.3, CM2, BN.1, XBF, CH.1.1, CH.1.1.1, CH.1.1.2, DU.1, EG.1, FK.1, EU.1.1, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1 and XBB.1.5.44 variants.

Accordingly, it may be advantageous that the RNA of the invention provides a SARS-CoV-2 spike protein comprising a substitution in position N460 to allow the induction of efficient immune responses against virus SARS-CoV-2 N460 variants.

In preferred embodiments, the SARS-CoV-2 spike protein comprises an amino acid substitution at position N460, wherein the amino acids N460 is substituted with K, R, E, D, Y (amino acid positions according to reference SEQ ID NO: 1). Accordingly, the antigenic peptide or protein selected from or derived from SARS-CoV-2 spike protein comprises a N460K, N460R, N460E, N460D, N460Y amino acid substitution. N460 variants might be especially powerful in combinations with F490S, R346T+F490S, R346T+Y144del+F490S, R346T+K444T, R346T+K444M, K444T, K444R, F486P, D614G, D614G+L452R, K444M, Y144del+G252V, Y144del+K444M, E484R, K356T, E180V, D215H, P521S, D80Y, G184V, N185D, T883I, E1144Q, Q613H, D215G and Q613H, or V83A+H146Q+Q83E+V213E+G252V+G339H+L368I+V445P+F486S+F490S.

In preferred embodiments, the SARS-CoV-2 spike protein comprises an amino acid substitution at position N460, wherein the amino acids N460 is substituted with K (amino acid positions according to reference SEQ ID NO: 1).

Accordingly, the antigenic peptide or protein selected from or derived from SARS-CoV-2 spike protein comprises a N460K amino acid substitution.

In embodiments, the SARS-CoV-2 spike protein comprises an amino acid substitution at position K444, wherein the amino acids K444 is substituted with a different amino acid (amino acid positions according to reference SEQ ID NO: 1).

Without wishing to be bound to theory, an amino acid substitution at position K444 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in K444 occurs near the top of the coronavirus spike, where it may alter the surface of the protein, which may help to evade some types of coronavirus antibodies. Such SARS-CoV-2 are called SARS-CoV-2 K444 variants throughout the present invention and include e.g. Omicron BQ.1.1, BQ.1.2, BU.1, CH.1.1, CH.1.1.1, CH.1.1.2, DU.1 or CM2.

Accordingly, it may be advantageous that the RNA of the invention provides a SARS-CoV-2 spike protein comprising a substitution in position K444 to allow the induction of efficient immune responses against virus SARS-CoV-2 K444 variants.

In embodiments, the SARS-CoV-2 spike protein comprises an amino acid substitution at position K444, wherein the amino acids K444 is substituted with M, R, T, E, D, S (amino acid positions according to reference SEQ ID NO: 1). Accordingly, the antigenic peptide or protein selected from or derived from SARS-CoV-2 spike protein comprises a K444M, K444R, K444T, K444E, K444D, K444S amino acid substitution. K444 variants might be especially powerful in combinations with R346T+N460K, N460K, Y144del+N460K, N185D, T883I, E1144Q, D215G+Q613H, or D614G+A1020S.

In embodiments, the SARS-CoV-2 spike protein comprises an amino acid substitution at position K444, wherein the amino acids K444 is substituted with M, R or T (amino acid positions according to reference SEQ ID NO: 1). Accordingly, the antigenic peptide or protein selected from or derived from SARS-CoV-2 spike protein comprises a K444M, K444R or K444T amino acid substitution.

In preferred embodiments, the SARS-CoV-2 spike protein comprises an amino acid substitution at position E484, wherein the amino acids E484 is substituted with a different amino acid (amino acid positions according to reference SEQ ID NO: 1).

Without wishing to be bound to theory, an amino acid substitution at position E484 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in E484 occurs on the surface of the lower part of the coronavirus spike, where it may alter the shape of the protein, which may help to evade some types of coronavirus antibodies. Such SARS-CoV-2 are called SARS-CoV-2 E484 variants throughout the present invention and include e.g. BQ.1.1, BQ.1.2, BQ.1.18, XBB.1, XBB.1.5, CM2.

Accordingly, it may be advantageous that the RNA of the invention provides a SARS-CoV-2 spike protein comprising a substitution in position E484 to allow the induction of efficient immune responses against virus SARS-CoV-2 E484 variants.

In preferred embodiments, the SARS-CoV-2 spike protein comprises an amino acid substitution at position E484, wherein the amino acids E484 is substituted with K, R, N, H (amino acid positions according to reference SEQ ID NO: 1). Accordingly, the antigenic peptide or protein selected from or derived from SARS-CoV-2 spike protein comprises a E484K, E484R, E484N, or E484H amino acid substitution.

In preferred embodiments, the SARS-CoV-2 spike protein comprises an amino acid substitution at position E484, wherein the amino acids E484 is substituted with R (amino acid positions according to reference SEQ ID NO: 1).

Accordingly, the antigenic peptide or protein selected from or derived from SARS-CoV-2 spike protein comprises a E484R amino acid substitution.

In preferred embodiments, the SARS-CoV-2 spike protein comprises an amino acid substitution at position F486, wherein the amino acids F486 is substituted with a different amino acid (amino acid positions according to reference SEQ ID NO: 1).

Without wishing to be bound to theory, an amino acid substitution at position F486 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in F486 occurs on the surface of the lower part of the coronavirus spike, where it may alter the shape of the protein, which may help to evade some types of coronavirus antibodies. Some variant strains might have higher transmissibility due to stronger ACE2 binding through F486 mutation. Such SARS-CoV-2 are called SARS-CoV-2 F486 variants throughout the present invention and include e.g. BQ.1.1, BQ.1.2, XBB.1, XBB.1.5, XBC.1, XBC.2, and XBF.

Accordingly, it may be advantageous that the RNA of the invention provides a SARS-CoV-2 spike protein comprising a substitution in position F486 to allow the induction of efficient immune responses against virus SARS-CoV-2 F486 variants.

In preferred embodiments, the SARS-CoV-2 spike protein comprises an amino acid substitution at position F486, wherein the amino acids F486 is substituted with I, L, V, P, S (amino acid positions according to reference SEQ ID NO: 1). Accordingly, the antigenic peptide or protein selected from or derived from SARS-CoV-2 spike protein comprises a F486I, F486I, F486V, F486P, or F486S amino acid substitution.

In preferred embodiments, the SARS-CoV-2 spike protein comprises an amino acid substitution at position F486, wherein the amino acids F486 is substituted with S (amino acid positions according to reference SEQ ID NO: 1). Accordingly, the antigenic peptide or protein selected from or derived from SARS-CoV-2 spike protein comprises a F486S amino acid substitution.

In preferred embodiments, the SARS-CoV-2 spike protein comprises an amino acid substitution at position F486, wherein the amino acids F486 is substituted with P (amino acid positions according to reference SEQ ID NO: 1). Accordingly, the antigenic peptide or protein selected from or derived from SARS-CoV-2 spike protein comprises a F486P amino acid substitution.

In embodiments, the SARS-CoV-2 spike protein comprises an amino acid substitution at position T604, wherein the amino acids T604 is substituted with a different amino acid (amino acid positions according to reference SEQ ID NO: 1).

Without wishing to be bound to theory, an amino acid substitution at position T604 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in T604 occurs on the surface of the lower part of the coronavirus spike, where it may alter the shape of the protein, which may help to evade some types of coronavirus antibodies. Such SARS-CoV-2 are called SARS-CoV-2 T604 variants throughout the present invention and include e.g. Omicron CA.1.

Accordingly, it may be advantageous that the RNA of the invention provides a SARS-CoV-2 spike protein comprising a substitution in position T604 to allow the induction of efficient immune responses against virus SARS-CoV-2 T604 variants.

In embodiments, the SARS-CoV-2 spike protein comprises an amino acid substitution at position T604, wherein the amino acids T604 is substituted with I, V, L, K, E (amino acid positions according to reference SEQ ID NO: 1). Accordingly, the antigenic peptide or protein selected from or derived from SARS-CoV-2 spike protein comprises a T604I, T604V, T604L, T604K, T604E amino acid substitution. T604 variants might be especially powerful in combinations with L452R.

In embodiments, the SARS-CoV-2 spike protein comprises an amino acid substitution at position T604, wherein the amino acids T604 is substituted with I (amino acid positions according to reference SEQ ID NO: 1). Accordingly, the antigenic peptide or protein selected from or derived from SARS-CoV-2 spike protein comprises a T604I amino acid substitution.

In embodiments, the SARS-CoV-2 spike protein comprises an amino acid substitution at position D574, wherein the amino acids D574 is substituted with a different amino acid (amino acid positions according to reference SEQ ID NO: 1).

Without wishing to be bound to theory, an amino acid substitution at position D574 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in D574 occurs on the surface in the lower part of the head of the coronavirus spike, where it may alter the surface of the protein, which may help to evade some types of coronavirus antibodies. Such SARS-CoV-2 are called SARS-CoV-2 D574 variants throughout the present invention and include e.g. BA.2.75.1.

Accordingly, it may be advantageous that the RNA of the invention provides a SARS-CoV-2 spike protein comprising a substitution in position D574 to allow the induction of efficient immune responses against virus SARS-CoV-2 D574 variants.

In embodiments, the SARS-CoV-2 spike protein comprises an amino acid substitution at position D574, wherein the amino acids D574 is substituted with V, I, L, E, K (amino acid positions according to reference SEQ ID NO: 1). Accordingly, the antigenic peptide or protein selected from or derived from SARS-CoV-2 spike protein comprises a D547V, D547I, D547L, D547E, or D547K amino acid substitution.

In embodiments, the SARS-CoV-2 spike protein comprises an amino acid substitution at position D574, wherein the amino acids D574 is substituted with V (amino acid positions according to reference SEQ ID NO: 1). Accordingly, the antigenic peptide or protein selected from or derived from SARS-CoV-2 spike protein comprises a D547V amino acid substitution.

In preferred embodiments, the SARS-CoV-2 spike protein comprises an amino acid substitution at position E180, wherein the amino acids E180 is substituted with a different amino acid (amino acid positions according to reference SEQ ID NO: 1).

Without wishing to be bound to theory, an amino acid substitution at position E180 may help SARS-CoV-2 virus variants to evade antibody detection of some types of antibodies induced in subjects vaccinated with first generation vaccines (designed e.g. against the original SARS- CoV-2 strain) or induced in subjects after infection with the original SARS-CoV-2 strain. A mutation/substitution in E180 occurs on the surface in the lower part of the head of the coronavirus spike, where it may alter the surface of the protein, which may help to evade some types of coronavirus antibodies. Such SARS-CoV-2 are called SARS-CoV-2 E180 variants throughout the present invention and include e.g. XBB.1.16.

Accordingly, it may be advantageous that the RNA of the invention provides a SARS-CoV-2 spike protein comprising a substitution in position E180 to allow the induction of efficient immune responses against virus SARS-CoV-2 E180 variants.

In preferred embodiments, the SARS-CoV-2 spike protein comprises an amino acid substitution at position E180, wherein the amino acids E180 is substituted with V, I, L, A (amino acid positions according to reference SEQ ID NO: 1). Accordingly, the antigenic peptide or protein selected from or derived from SARS-CoV-2 spike protein comprises a E180V, E180I, E180L or E180 A amino acid substitution.

In preferred embodiments, the SARS-CoV-2 spike protein comprises an amino acid substitution at position E180, wherein the amino acids E180 is substituted with V (amino acid positions according to reference SEQ ID NO: 1). Accordingly, the antigenic peptide or protein selected from or derived from SARS-CoV-2 spike protein comprises a E180V amino acid substitution.

In embodiments, the SARS-CoV-2 spike protein comprises an amino acid substitution at position R21, wherein the amino acids R21 is substituted with a different amino acid (amino acid positions according to reference SEQ ID NO: 1).

Without wishing to be bound by theory, an amino acid substitution at position R21 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in R21 occurs on the surface in the lower part of the head of the coronavirus spike, where it may alter the surface of the protein, which may help to evade some types of coronavirus antibodies. Such SARS-CoV-2 are called SARS-CoV-2 R21 variants throughout the present invention and include e.g. XAY-2.

Accordingly, it may be advantageous that the RNA of the invention provides a SARS-CoV-2 spike protein comprising a substitution in position R21 to allow the induction of efficient immune responses against virus SARS-CoV-2 R21 variants.

In embodiments, the SARS-CoV-2 spike protein comprises an amino acid substitution at position R21, wherein the amino acids R21 is substituted with G, A, L, I (amino acid positions according to reference SEQ ID NO: 1). Accordingly, the antigenic peptide or protein selected from or derived from SARS-CoV-2 spike protein comprises a R21G, R21A, R21L or R21I amino acid substitution.

In embodiments, the SARS-CoV-2 spike protein comprises an amino acid substitution at position R21, wherein the amino acids R21 is substituted with G (amino acid positions according to reference SEQ ID NO: 1). Accordingly, the antigenic peptide or protein selected from or derived from SARS-CoV-2 spike protein comprises a R21G amino acid substitution.

In preferred embodiments, the SARS-CoV-2 spike protein comprises an amino acid substitution at position V83, wherein the amino acids V83 is substituted with a different amino acid (amino acid positions according to reference SEQ ID NO: 1).

Without wishing to be bound to theory, an amino acid substitution at position V83 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in V83 occurs near the top of the coronavirus spike in the NTD, where it may alter the shape of the protein, which may help to evade some types of coronavirus antibodies. Such SARS-CoV-2 are called SARS-CoV-2 V83 variants throughout the present invention and include e.g. XBB.1 and BJ.1.

Accordingly, it may be advantageous that the RNA of the invention provides a SARS-CoV-2 spike protein comprising a substitution in position V83 to allow the induction of efficient immune responses against virus SARS-CoV-2 V83 variants.

In preferred embodiments, the SARS-CoV-2 spike protein comprises an amino acid substitution at position V83, wherein the amino acids V83 is substituted with A, S, T (amino acid positions according to reference SEQ ID NO: 1).

Accordingly, the antigenic peptide or protein selected from or derived from SARS-CoV-2 spike protein comprises a V83A, V83S, V83T amino acid substitution. V83 variants might be especially powerful in combination with N460K+H146Q+Q83E+V213E+G252V+G339H+L368I+V445P+F486S+F490S, or H146Q+Q183E+V213E+G252V+G339H+L368I+V445P+N460K+F486P+F490S.

In preferred embodiments, the SARS-CoV-2 spike protein comprises an amino acid substitution at position V83, wherein the amino acids V83 is substituted with A (amino acid positions according to reference SEQ ID NO: 1). Accordingly, the antigenic peptide or protein selected from or derived from SARS-CoV-2 spike protein comprises a V83A amino acid substitution.

In preferred embodiments, the SARS-CoV-2 spike protein comprises an amino acid substitution at position H146, wherein the amino acids H146 is substituted with a different amino acid (amino acid positions according to reference SEQ ID NO: 1).

Without wishing to be bound to theory, an amino acid substitution at position H146 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in H146 occurs near the top of the coronavirus spike in the NTD, where it may alter the surface of the protein, which may help to evade some types of coronavirus antibodies. Such SARS-CoV-2 are called SARS-CoV-2H146 variants throughout the present invention and include e.g. XBB.1, XBB.1.5 and BJ.1.

Accordingly, it may be advantageous that the RNA of the invention provides a SARS-CoV-2 spike protein comprising a substitution in position H146 to allow the induction of efficient immune responses against virus SARS-CoV-2H146 variants.

In preferred embodiments, the SARS-CoV-2 spike protein comprises an amino acid substitution at position H146, wherein the amino acids H146 is substituted with Q, E, K, T, V (amino acid positions according to reference SEQ ID NO: 1). Accordingly, the antigenic peptide or protein selected from or derived from SARS-CoV-2 spike protein comprises a H146Q, H146E, H146K, H146T, or H146V amino acid substitution. H146 variants might be especially powerful in combinations with N460K+V83A+Q83E+V213E+G252V+G339H+L368I+V445P+F486S+F490S.

In preferred embodiments, the SARS-CoV-2 spike protein comprises an amino acid substitution at position H146, wherein the amino acids H146 is substituted with Q (amino acid positions according to reference SEQ ID NO: 1). Accordingly, the antigenic peptide or protein selected from or derived from SARS-CoV-2 spike protein comprises a H146Q amino acid substitution.

In embodiments, the SARS-CoV-2 spike protein comprises an amino acid substitution at position K147, wherein the amino acids K147 is substituted with a different amino acid (amino acid positions according to reference SEQ ID NO: 1).

Without wishing to be bound to theory, an amino acid substitution at position K147 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in K147 occurs near the top of the coronavirus spike in the NTD, where it may alter the surface of the protein, which may help to evade some types of coronavirus antibodies. Such SARS-CoV-2 are called SARS-CoV-2 K147 variants throughout the present invention and include e.g. BA.2.75, BA.2.75.1, BA.2.75.2, BM.1.1, BM.1.1.1, or CA.1.

Accordingly, it may be advantageous that the RNA of the invention provides a SARS-CoV-2 spike protein comprising a substitution in position K147 to allow the induction of efficient immune responses against virus SARS-CoV-2 K147 variants.

In embodiments, the SARS-CoV-2 spike protein comprises an amino acid substitution at position K147, wherein the amino acids K147 is substituted with E, D, Y, L, V (amino acid positions according to reference SEQ ID NO: 1). Accordingly, the antigenic peptide or protein selected from or derived from SARS-CoV-2 spike protein comprises a K147E, K147D, K147Y, K147L, or K147V amino acid substitution.

In embodiments, the SARS-CoV-2 spike protein comprises an amino acid substitution at position N501, wherein the amino acids K147 is substituted with E (amino acid positions according to reference SEQ ID NO: 1). Accordingly, the antigenic peptide or protein selected from or derived from SARS-CoV-2 spike protein comprises a K147E amino acid substitution.

In preferred embodiments, the SARS-CoV-2 spike protein comprises an amino acid substitution at position Q183, wherein the amino acids Q183 is substituted with a different amino acid (amino acid positions according to reference SEQ ID NO: 1).

Without wishing to be bound to theory, an amino acid substitution at position Q183 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in Q183 occurs near the top of the coronavirus spike, where it may alter the shape of the protein, which may help to evade some types of coronavirus antibodies. Such SARS-CoV-2 are called SARS-CoV-2 Q183 variants throughout the present invention and include e.g. XBB.1 and BJ.1.

Accordingly, it may be advantageous that the RNA of the invention provides a SARS-CoV-2 spike protein comprising a substitution in position Q183 to allow the induction of efficient immune responses against virus SARS-CoV-2 Q183 variants.

In preferred embodiments, the SARS-CoV-2 spike protein comprises an amino acid substitution at position Q183, wherein the amino acids Q183 is substituted with E, D, R, or K (amino acid positions according to reference SEQ ID NO: 1). Accordingly, the antigenic peptide or protein selected from or derived from SARS-CoV-2 spike protein comprises a Q183E, Q183D, Q183R, or Q183K amino acid substitution.

In preferred embodiments, the SARS-CoV-2 spike protein comprises an amino acid substitution at position Q183, wherein the amino acids Q183 is substituted with E (amino acid positions according to reference SEQ ID NO: 1). Accordingly, the antigenic peptide or protein selected from or derived from SARS-CoV-2 spike protein comprises a Q183E amino acid substitution.

In embodiments, the SARS-CoV-2 spike protein comprises an amino acid substitution at position G184, wherein the amino acids G184 is substituted with a different amino acid (amino acid positions according to reference SEQ ID NO: 1).

Without wishing to be bound to theory, an amino acid substitution at position G184 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in G184 occurs on the surface in the lower part of the head of the coronavirus spike, where it may alter the surface of the protein, which may help to evade some types of coronavirus antibodies. Such SARS-CoV-2 are called SARS-CoV-2 G184 variants throughout the present invention and include e.g. XBB.2.3.2.

Accordingly, it may be advantageous that the RNA of the invention provides a SARS-CoV-2 spike protein comprising a substitution in position G184 to allow the induction of efficient immune responses against virus SARS-CoV-2 G184 variants.

In embodiments, the SARS-CoV-2 spike protein comprises an amino acid substitution at position G184, wherein the amino acids G184 is substituted with V, A, L, I (amino acid positions according to reference SEQ ID NO: 1). Accordingly, the antigenic peptide or protein selected from or derived from SARS-CoV-2 spike protein comprises a G184V, G184A, G184L or G184I amino acid substitution.

In embodiments, the SARS-CoV-2 spike protein comprises an amino acid substitution at position G184, wherein the amino acids G184 is substituted with V (amino acid positions according to reference SEQ ID NO: 1). Accordingly, the antigenic peptide or protein selected from or derived from SARS-CoV-2 spike protein comprises a G184V amino acid substitution.

In embodiments, the SARS-CoV-2 spike protein comprises an amino acid substitution at position N185, wherein the amino acids N185 is substituted with a different amino acid (amino acid positions according to reference SEQ ID NO: 1).

Without wishing to be bound to theory, an amino acid substitution at position N185 may help SARS-CoV-2 virus variants to evade antibody detection of some types of antibodies induced in subjects vaccinated with first generation vaccines (designed e.g. against the original SARS- CoV-2 strain) or induced in subjects after infection with the original SARS-CoV-2 strain. A mutation/substitution in N185 occurs on the surface in the lower part of the head of the coronavirus spike, where it may alter the surface of the protein, which may help to evade some types of coronavirus antibodies. Such SARS-CoV-2 are called SARS-CoV-2 N185 variants throughout the present invention and include e.g. CH.1.1.1.

Accordingly, it may be advantageous that the RNA of the invention provides a SARS-CoV-2 spike protein comprising a substitution in position N185 to allow the induction of efficient immune responses against virus SARS-CoV-2 N185 variants.

In embodiments, the SARS-CoV-2 spike protein comprises an amino acid substitution at position N185, wherein the amino acids N185 is substituted with D or E (amino acid positions according to reference SEQ ID NO: 1). Accordingly, the antigenic peptide or protein selected from or derived from SARS-CoV-2 spike protein comprises a N185D or N185E amino acid substitution.

In embodiments, the SARS-CoV-2 spike protein comprises an amino acid substitution at position N185, wherein the amino acids N185 is substituted with D (amino acid positions according to reference SEQ ID NO: 1). Accordingly, the antigenic peptide or protein selected from or derived from SARS-CoV-2 spike protein comprises a N185D amino acid substitution.

In embodiments, the SARS-CoV-2 spike protein comprises an amino acid substitution at position F186, wherein the amino acids F186 is substituted with a different amino acid (amino acid positions according to reference SEQ ID NO: 1).

Without wishing to be bound to theory, an amino acid substitution at position F186 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in F186 occurs on the surface in the lower part of the head of the coronavirus spike, where it may alter the surface of the protein, which may help to evade some types of coronavirus antibodies. Such SARS-CoV-2 are called SARS-CoV-2 F186 variants throughout the present invention and include e.g. XAY-2.

Accordingly, it may be advantageous that the RNA of the invention provides a SARS-CoV-2 spike protein comprising a substitution in position F186 to allow the induction of efficient immune responses against virus SARS-CoV-2 F186 variants.

In embodiments, the SARS-CoV-2 spike protein comprises an amino acid substitution at position F186, wherein the amino acids F186 is substituted with L, V, I or A (amino acid positions according to reference SEQ ID NO: 1). Accordingly, the antigenic peptide or protein selected from or derived from SARS-CoV-2 spike protein comprises a F186L, F186V, F186I or F186A amino acid substitution.

In embodiments, the SARS-CoV-2 spike protein comprises an amino acid substitution at position F186, wherein the amino acids F186 is substituted with L (amino acid positions according to reference SEQ ID NO: 1). Accordingly, the antigenic peptide or protein selected from or derived from SARS-CoV-2 spike protein comprises a F186L amino acid substitution.

In embodiments, the SARS-CoV-2 spike protein comprises an amino acid substitution at position G257, wherein the amino acids G257 is substituted with a different amino acid (amino acid positions according to reference SEQ ID NO: 1).

Without wishing to be bound to theory, an amino acid substitution at position G257 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in G257 occurs near the top of the coronavirus spike, where it may alter the shape of the protein, which may help to evade some types of coronavirus antibodies. Such SARS-CoV-2 are called SARS-CoV-2 G257 variants throughout the present invention and include e.g. Omicron BA.2.75, BA.2.75.1, BA.2.75.2, CM2, BM.1.1, BM.1.1.1 and CA.1.

Accordingly, it may be advantageous that the RNA of the invention provides a SARS-CoV-2 spike protein comprising a substitution in position G257 to allow the induction of efficient immune responses against virus SARS-CoV-2 G257 variants.

In embodiments, the SARS-CoV-2 spike protein comprises an amino acid substitution at position G257, wherein the amino acids G257 is substituted with D, S, N, A, or C (amino acid positions according to reference SEQ ID NO: 1). Accordingly, the antigenic peptide or protein selected from or derived from SARS-CoV-2 spike protein comprises a G257D, G257S, G257N, G257A, or G257C amino acid substitution.

In embodiments, the SARS-CoV-2 spike protein comprises an amino acid substitution at position G257, wherein the amino acids G257 is substituted with D or S (amino acid positions according to reference SEQ ID NO: 1). Accordingly, the antigenic peptide or protein selected from or derived from SARS-CoV-2 spike protein comprises a G257D or G257S amino acid substitution.

In preferred embodiments, the SARS-CoV-2 spike protein comprises an amino acid substitution at position L368, wherein the amino acids L368 is substituted with a different amino acid (amino acid positions according to reference SEQ ID NO: 1).

Without wishing to be bound to theory, an amino acid substitution at position L368 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in L368 occurs near the top of the coronavirus spike, where it may alter the shape of the protein, which may help to evade some types of coronavirus antibodies. Such SARS-CoV-2 are called SARS-CoV-2 L368 variants throughout the present invention and include e.g. Omicron XBB.1 and BJ.1.

Accordingly, it may be advantageous that the RNA of the invention provides a SARS-CoV-2 spike protein comprising a substitution in position L368 to allow the induction of efficient immune responses against virus SARS-CoV-2 L368 variants.

In preferred embodiments, the SARS-CoV-2 spike protein comprises an amino acid substitution at position L368, wherein the amino acids L368 is substituted with I (amino acid positions according to reference SEQ ID NO: 1). Accordingly, the antigenic peptide or protein selected from or derived from SARS-CoV-2 spike protein comprises a L368I amino acid substitution. L368 variants might be especially powerful in combinations with V83A+H146Q+Q83E+V213E+G252V+G339H+V445P+N460K+F486S+F490S.

In preferred embodiments, the SARS-CoV-2 spike protein comprises an amino acid substitution at position L368, wherein the amino acids L368 is substituted with I, V, K, or E (amino acid positions according to reference SEQ ID NO: 1). Accordingly, the antigenic peptide or protein selected from or derived from SARS-CoV-2 spike protein comprises a L368I, L368V, L368K, or L368E amino acid substitution.

In embodiments, the SARS-CoV-2 spike protein comprises an amino acid substitution at position I410, wherein the amino acids I410 is substituted with a different amino acid (amino acid positions according to reference SEQ ID NO: 1).

Without wishing to be bound to theory, an amino acid substitution at position I410 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in I410 occurs on the surface in the lower part of the head of the coronavirus spike, where it may alter the surface of the protein, which may help to evade some types of coronavirus antibodies. Such SARS-CoV-2 are called SARS-CoV-2 I410 variants throughout the present invention and include e.g. EU.1.1.

Accordingly, it may be advantageous that the RNA of the invention provides a SARS-CoV-2 spike protein comprising a substitution in position I410 to allow the induction of efficient immune responses against virus SARS-CoV-2 I410 variants.

In embodiments, the SARS-CoV-2 spike protein comprises an amino acid substitution at position I410, wherein the amino acids I410 is substituted with V, L or A (amino acid positions according to reference SEQ ID NO: 1).

Accordingly, the antigenic peptide or protein selected from or derived from SARS-CoV-2 spike protein comprises a I410V, I410L or I410A amino acid substitution.

In embodiments, the SARS-CoV-2 spike protein comprises an amino acid substitution at position I410, wherein the amino acids I410 is substituted with V (amino acid positions according to reference SEQ ID NO: 1). Accordingly, the antigenic peptide or protein selected from or derived from SARS-CoV-2 spike protein comprises a I410V amino acid substitution.

In embodiments, the SARS-CoV-2 spike protein comprises an amino acid substitution at position P521, wherein the amino acids P521 is substituted with a different amino acid (amino acid positions according to reference SEQ ID NO: 1).

Without wishing to be bound to theory, an amino acid substitution at position P521 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in P521 occurs on the surface in the lower part of the head of the coronavirus spike, where it may alter the surface of the protein, which may help to evade some types of coronavirus antibodies. Such SARS-CoV-2 are called SARS-CoV-2 P521 variants throughout the present invention and include e.g. XBB.2.3.

Accordingly, it may be advantageous that the RNA of the invention provides a SARS-CoV-2 spike protein comprising a substitution in position P521 to allow the induction of efficient immune responses against virus SARS-CoV-2 P521 variants.

In embodiments, the SARS-CoV-2 spike protein comprises an amino acid substitution at position P521, wherein the amino acids P521 is substituted with S or T (amino acid positions according to reference SEQ ID NO: 1). Accordingly, the antigenic peptide or protein selected from or derived from SARS-CoV-2 spike protein comprises a P521S or P521T amino acid substitution.

In embodiments, the SARS-CoV-2 spike protein comprises an amino acid substitution at position P521, wherein the amino acids P521 is substituted with S (amino acid positions according to reference SEQ ID NO: 1). Accordingly, the antigenic peptide or protein selected from or derived from SARS-CoV-2 spike protein comprises a P521S amino acid substitution.

In embodiments, the SARS-CoV-2 spike protein comprises an amino acid substitution at position N658, wherein the amino acids N658 is substituted with a different amino acid (amino acid positions according to reference SEQ ID NO: 1).

Without wishing to be bound to theory, an amino acid substitution at position N658 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in N658 occurs on the surface of the coronavirus spike on the lower part of the head next to an N-linked Glycosylation site, where it may alter the shape of the protein, which may help to evade some types of coronavirus antibodies. Such SARS-CoV-2 are called SARS-CoV-2 N658 variants throughout the present invention and include e.g. Omicron BA.4.

Accordingly, it may be advantageous that the RNA of the invention provides a SARS-CoV-2 spike protein comprising a substitution in position N658 to allow the induction of efficient immune responses against virus SARS-CoV-2 N658 variants.

In embodiments, the SARS-CoV-2 spike protein comprises an amino acid substitution at position N658, wherein the amino acids N658 is substituted with S, A, G, D, or T (amino acid positions according to reference SEQ ID NO: 1).

Accordingly, the antigenic peptide or protein selected from or derived from SARS-CoV-2 spike protein comprises a N658S, N658A, N658G, N658D, or N658T amino acid substitution.

In embodiments, the SARS-CoV-2 spike protein comprises an amino acid substitution at position N658, wherein the amino acids N658 is substituted with S (amino acid positions according to reference SEQ ID NO: 1). Accordingly, the antigenic peptide or protein selected from or derived from SARS-CoV-2 spike protein comprises a N658S amino acid substitution.

In embodiments, the SARS-CoV-2 spike protein comprises an amino acid substitution at position G798, wherein the amino acids G798 is substituted with a different amino acid (amino acid positions according to reference SEQ ID NO: 1).

Without wishing to be bound to theory, an amino acid substitution at position G798 may help SARS-CoV-2 virus variants to evade antibody detection of some types of antibodies induced in subjects vaccinated with first generation vaccines (designed e.g. against the original SARS- CoV-2 strain) or induced in subjects after infection with the original SARS-CoV-2 strain. A mutation/substitution in G798 occurs in the S2 part of the Spike protein which may help to evade some types of coronavirus antibodies. Such SARS-CoV-2 are called SARS-CoV-2 G798 variants throughout the present invention and include e.g. Omicron BJ.1.

Accordingly, it may be advantageous that the RNA of the invention provides a SARS-CoV-2 spike protein comprising a substitution in position G798 to allow the induction of efficient immune responses against virus SARS-CoV-2 G798 variants.

In embodiments, the SARS-CoV-2 spike protein comprises an amino acid substitution at position G798, wherein the amino acids G798 is substituted with D (amino acid positions according to reference SEQ ID NO: 1). Accordingly, the antigenic peptide or protein selected from or derived from SARS-CoV-2 spike protein comprises a G798D amino acid substitution.

In embodiments, the SARS-CoV-2 spike protein comprises an amino acid substitution at position G798, wherein the amino acids G798 is substituted with D, E, S, T, or A (amino acid positions according to reference SEQ ID NO: 1).

Accordingly, the antigenic peptide or protein selected from or derived from SARS-CoV-2 spike protein comprises a G798D, G798E, G798S, G798T, or G798A amino acid substitution.

In embodiments, the SARS-CoV-2 spike protein comprises an amino acid substitution at position T883, wherein the amino acids T883 is substituted with a different amino acid (amino acid positions according to reference SEQ ID NO: 1).

Without wishing to be bound to theory, an amino acid substitution at position T883 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in T883 occurs on the surface in the lower part of the head of the coronavirus spike, where it may alter the surface of the protein, which may help to evade some types of coronavirus antibodies. Such SARS-CoV-2 are called SARS-CoV-2 T883 variants throughout the present invention and include e.g. CH.1.1.2.

Accordingly, it may be advantageous that the RNA of the invention provides a SARS-CoV-2 spike protein comprising a substitution in position T883 to allow the induction of efficient immune responses against virus SARS-CoV-2 T883 variants.

In embodiments, the SARS-CoV-2 spike protein comprises an amino acid substitution at position T883, wherein the amino acids T883 is substituted with I, V, L or A (amino acid positions according to reference SEQ ID NO: 1).

Accordingly, the antigenic peptide or protein selected from or derived from SARS-CoV-2 spike protein comprises a T883I, T883V, T883L or T883A amino acid substitution.

In embodiments, the SARS-CoV-2 spike protein comprises an amino acid substitution at position T883, wherein the amino acids T883 is substituted with I (amino acid positions according to reference SEQ ID NO: 1). Accordingly, the antigenic peptide or protein selected from or derived from SARS-CoV-2 spike protein comprises a T883I amino acid substitution.

In embodiments, the SARS-CoV-2 spike protein comprises an amino acid substitution at position S1003, wherein the amino acids S1003 is substituted with a different amino acid (amino acid positions according to reference SEQ ID NO: 1).

Without wishing to be bound to theory, an amino acid substitution at position S1003 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in S1003 occurs in the S2 part of the protein which may help to evade some types of coronavirus antibodies. Such SARS-CoV-2 are called SARS-CoV-2 S1003 variants throughout the present invention and include Omicron BJ.1.

Accordingly, it may be advantageous that the RNA of the invention provides a SARS-CoV-2 spike protein comprising a substitution in position S1003 to allow the induction of efficient immune responses against virus SARS-CoV-2 S1003 variants.

In embodiments, the SARS-CoV-2 spike protein comprises an amino acid substitution at position S1003, wherein the amino acids S1003 is substituted with I, V, L, K, or E (amino acid positions according to reference SEQ ID NO: 1).

Accordingly, the antigenic peptide or protein selected from or derived from SARS-CoV-2 spike protein comprises a S1003I amino acid substitution.

In embodiments, the SARS-CoV-2 spike protein comprises an amino acid substitution at position S1003, wherein the amino acids S1003 is substituted with I, V, L, K, or E (amino acid positions according to reference SEQ ID NO: 1).

Accordingly, the antigenic peptide or protein selected from or derived from SARS-CoV-2 spike protein comprises a S1003I, S1003V, S1003L, S1003K, or S1003E amino acid substitution.

In embodiments, the SARS-CoV-2 spike protein comprises an amino acid substitution at position A1020, wherein the amino acid A1020 is substituted with a different amino acid (amino acid positions according to reference SEQ ID NO: 1).

Without wishing to be bound to theory, an amino acid substitution at position A1020 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in A1020 occurs In the S2 part of the spike protein which may help to evade some types of coronavirus antibodies. Such SARS-CoV-2 are called SARS-CoV-2 A1020 variants throughout the present invention and include e.g. Omicron BF.5.

Accordingly, it may be advantageous that the RNA of the invention provides a SARS-CoV-2 spike protein comprising a substitution in position A1020 to allow the induction of efficient immune responses against virus SARS-CoV-2 A1020 variants.

In embodiments, the SARS-CoV-2 spike protein comprises an amino acid substitution at position A1020, wherein the amino acids A1020 is substituted with S (amino acid positions according to reference SEQ ID NO: 1). Accordingly, the antigenic peptide or protein selected from or derived from SARS-CoV-2 spike protein comprises a A1020S amino acid substitution. A1020 variants might be especially powerful in combinations with K444M+D614G+A1020S.

In embodiments, the SARS-CoV-2 spike protein comprises an amino acid substitution at position A1020, wherein the amino acids A1020 is substituted with S, T, D, N, or G (amino acid positions according to reference SEQ ID NO: 1). Accordingly, the antigenic peptide or protein selected from or derived from SARS-CoV-2 spike protein comprises a A1020S, A1020T, A1020D, A1020N, or A1020G amino acid substitution.

In embodiments, the SARS-CoV-2 spike protein comprises an amino acid substitution at position E1144, wherein the amino acids E1144 is substituted with a different amino acid (amino acid positions according to reference SEQ ID NO: 1).

Without wishing to be bound to theory, an amino acid substitution at position E1144 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in E1144 occurs on the surface in the lower part of the head of the coronavirus spike, where it may alter the surface of the protein, which may help to evade some types of coronavirus antibodies. Such SARS-CoV-2 are called SARS-CoV-2 E1144 variants throughout the present invention and include e.g. DU.1.

Accordingly, it may be advantageous that the RNA of the invention provides a SARS-CoV-2 spike protein comprising a substitution in position E1144 to allow the induction of efficient immune responses against virus SARS-CoV-2 E1144 variants.

In embodiments, the SARS-CoV-2 spike protein comprises an amino acid substitution at position E1144, wherein the amino acids E1144 is substituted with Q or N (amino acid positions according to reference SEQ ID NO: 1).

Accordingly, the antigenic peptide or protein selected from or derived from SARS-CoV-2 spike protein comprises a E1144Q or E1144N amino acid substitution.

In embodiments, the SARS-CoV-2 spike protein comprises an amino acid substitution at position E1144, wherein the amino acids E1144 is substituted with Q (amino acid positions according to reference SEQ ID NO: 1). Accordingly, the antigenic peptide or protein selected from or derived from SARS-CoV-2 spike protein comprises a E1144Q amino acid substitution.

In embodiments, the SARS-CoV-2 spike protein comprises an amino acid substitution at position D1199, wherein the amino acids D1199 is substituted with a different amino acid (amino acid positions according to reference SEQ ID NO: 1).

Without wishing to be bound to theory, an amino acid substitution at position D1199 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in D1199 occurs in the S2 part of the spike protein which may help to evade some types of coronavirus antibodies. Such SARS-CoV-2 are called SARS-CoV-2 D1199 variants throughout the present invention and include e.g. BA.2.7.5.2 and CA.1 Accordingly, it may be advantageous that the RNA of the invention provides a SARS-CoV-2 spike protein comprising a substitution in position D1199 to allow the induction of efficient immune responses against virus SARS-CoV-2 D1199 variants.

In embodiments, the SARS-CoV-2 spike protein comprises an amino acid substitution at position D1199, wherein the amino acids D1199 is substituted with N, E, S, Q, K, or T (amino acid positions according to reference SEQ ID NO: 1). Accordingly, the antigenic peptide or protein selected from or derived from SARS-CoV-2 spike protein comprises a D1199N, D1199E, D1199S, D1199Q, D1199K, or D1199T amino acid substitution. D1199 variants might be especially powerful in combinations with R346T+F486S or R346T+F486P.

In embodiments, the SARS-CoV-2 spike protein comprises an amino acid substitution at position D1199, wherein the amino acids D1199 is substituted with N (amino acid positions according to reference SEQ ID NO: 1). Accordingly, the antigenic peptide or protein selected from or derived from SARS-CoV-2 spike protein comprises a D1199N amino acid substitution.

In embodiments, the SARS-CoV-2 spike protein comprises an amino acid substitution at position C1243, wherein the amino acids C1243 is substituted with a different amino acid (amino acid positions according to reference SEQ ID NO: 1).

Without wishing to be bound to theory, an amino acid substitution at position C1243 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in C1243 occurs on the surface in the lower part of the head of the coronavirus spike, where it may alter the surface of the protein, which may help to evade some types of coronavirus antibodies. Such SARS-CoV-2 are called SARS-CoV-2 C1243 variants throughout the present invention and include e.g. BF.7.14.

Accordingly, it may be advantageous that the RNA of the invention provides a SARS-CoV-2 spike protein comprising a substitution in position C1243 to allow the induction of efficient immune responses against virus SARS-CoV-2 C1243 variants.

In embodiments, the SARS-CoV-2 spike protein comprises an amino acid substitution at position C1243, wherein the amino acids C1243 is substituted with F, W or Y (amino acid positions according to reference SEQ ID NO: 1). Accordingly, the antigenic peptide or protein selected from or derived from SARS-CoV-2 spike protein comprises a C1243F, C1243W or C1243Y amino acid substitution.

In embodiments, the SARS-CoV-2 spike protein comprises an amino acid substitution at position C1243, wherein the amino acids C1243 is substituted with F (amino acid positions according to reference SEQ ID NO: 1). Accordingly, the antigenic peptide or protein selected from or derived from SARS-CoV-2 spike protein comprises a C1243F amino acid substitution.

In embodiments, the SARS-CoV-2 spike protein comprises an amino acid substitution at position S256, wherein the amino acids 256 is substituted with a different amino acid (amino acid positions according to reference SEQ ID NO: 1). Position S256 is frequently mutated in variants XBC.1 and XBC.2.

Without wishing to be bound to theory, an amino acid substitution at position S256 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in S256 occurs on the coronavirus spike, where it may alter the shape of the protein, which may help to evade some types of coronavirus antibodies. Such SARS-CoV-2 are called SARS-CoV-2 S256 variants throughout the present invention and include e.g. XBC.1 and XBC.2.

Accordingly, it may be advantageous that the RNA of the invention provides a SARS-CoV-2 spike protein comprising a substitution in position S256 to allow the induction of efficient immune responses against virus SARS-CoV-2 S256 variants.

In embodiments, the SARS-CoV-2 spike protein comprises an amino acid substitution at position S256, wherein the amino acids S256 is substituted with L, V, A, I (amino acid positions according to reference SEQ ID NO: 1). Accordingly, the antigenic peptide or protein selected from or derived from SARS-CoV-2 spike protein comprises a S256L, S256V, S256A, S256I amino acid substitution.

In embodiments, the SARS-CoV-2 spike protein comprises an amino acid substitution at position S256, wherein the amino acids S256 is substituted with L (amino acid positions according to reference SEQ ID NO: 1). Accordingly, the antigenic peptide or protein selected from or derived from SARS-CoV-2 spike protein comprises a S256L amino acid substitution.

In embodiments, the SARS-CoV-2 spike protein comprises an amino acid substitution at position I666, wherein the amino acids 666 is substituted with a different amino acid (amino acid positions according to reference SEQ ID NO: 1). Position I666 is frequently mutated in variant BQ.1.2.

Without wishing to be bound to theory, an amino acid substitution at position I666 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in I666 occurs on the coronavirus spike, where it may alter the shape of the protein, which may help to evade some types of coronavirus antibodies. Such SARS-CoV-2 are called SARS-CoV-2 I666 variants throughout the present invention and include e.g. BQ.1.2.

Accordingly, it may be advantageous that the RNA of the invention provides a SARS-CoV-2 spike protein comprising a substitution in position I666 to allow the induction of efficient immune responses against virus SARS-CoV-2 I666 variants.

In embodiments, the SARS-CoV-2 spike protein comprises an amino acid substitution at position I666, wherein the amino acids I666 is substituted with V, L, A (amino acid positions according to reference SEQ ID NO: 1). Accordingly, the antigenic peptide or protein selected from or derived from SARS-CoV-2 spike protein comprises a I666V, I666L, I666A amino acid substitution.

In embodiments, the SARS-CoV-2 spike protein comprises an amino acid substitution at position I666, wherein the amino acids I666 is substituted with V (amino acid positions according to reference SEQ ID NO: 1). Accordingly, the antigenic peptide or protein selected from or derived from SARS-CoV-2 spike protein comprises a I666V amino acid substitution.

In embodiments, the SARS-CoV-2 spike protein comprises an amino acid substitution at position K182, wherein the amino acids 182 is substituted with a different amino acid (amino acid positions according to reference SEQ ID NO: 1). Position K182 is frequently mutated in variant XBB.2.3.3.

Without wishing to be bound to theory, an amino acid substitution at position K182 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in K182 occurs on the coronavirus spike, where it may alter the shape of the protein, which may help to evade some types of coronavirus antibodies. Such SARS-CoV-2 are called SARS-CoV-2 K182 variants throughout the present invention and include e.g. XBB.2.3.3.

Accordingly, it may be advantageous that the RNA of the invention provides a SARS-CoV-2 spike protein comprising a substitution in position K182 to allow the induction of efficient immune responses against virus SARS-CoV-2 K182 variants.

In embodiments, the SARS-CoV-2 spike protein comprises an amino acid substitution at position K182, wherein the amino acids K182 is substituted with N, Q, S, T (amino acid positions according to reference SEQ ID NO: 1). Accordingly, the antigenic peptide or protein selected from or derived from SARS-CoV-2 spike protein comprises a K182N, K182Q, K182S, K182T amino acid substitution.

In embodiments, the SARS-CoV-2 spike protein comprises an amino acid substitution at position K182, wherein the amino acids K182 is substituted with N (amino acid positions according to reference SEQ ID NO: 1). Accordingly, the antigenic peptide or protein selected from or derived from SARS-CoV-2 spike protein comprises a K182N amino acid substitution.

In embodiments, the SARS-CoV-2 spike protein comprises an amino acid substitution at position Y200, wherein the amino acids 200 is substituted with a different amino acid (amino acid positions according to reference SEQ ID NO: 1). Position Y200 is frequently mutated in variant XBB.1.22.1.

Without wishing to be bound to theory, an amino acid substitution at position Y200 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in Y200 occurs on the coronavirus spike, where it may alter the shape of the protein, which may help to evade some types of coronavirus antibodies. Such SARS-CoV-2 are called SARS-CoV-2 Y200 variants throughout the present invention and include e.g. XBB.1.22.1.

Accordingly, it may be advantageous that the RNA of the invention provides a SARS-CoV-2 spike protein comprising a substitution in position Y200 to allow the induction of efficient immune responses against virus SARS-CoV-2 Y200 variants.

In embodiments, the SARS-CoV-2 spike protein comprises an amino acid substitution at position Y200, wherein the amino acids Y200 is substituted with C (amino acid positions according to reference SEQ ID NO: 1). Accordingly, the antigenic peptide or protein selected from or derived from SARS-CoV-2 spike protein comprises a Y200C amino acid substitution.

In embodiments, the SARS-CoV-2 spike protein comprises an amino acid substitution at position L518, wherein the amino acids 518 is substituted with a different amino acid (amino acid positions according to reference SEQ ID NO: 1). Position L518 is frequently mutated in variant GB.1.

Without wishing to be bound to theory, an amino acid substitution at position L518 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in L518 occurs on the coronavirus spike, where it may alter the shape of the protein, which may help to evade some types of coronavirus antibodies. Such SARS-CoV-2 are called SARS-CoV-2 L518 variants throughout the present invention and include e.g. GB.1.

Accordingly, it may be advantageous that the RNA of the invention provides a SARS-CoV-2 spike protein comprising a substitution in position L518 to allow the induction of efficient immune responses against virus SARS-CoV-2 L518 variants.

In embodiments, the SARS-CoV-2 spike protein comprises an amino acid substitution at position K182, wherein the amino acids L518 is substituted with V, I, A (amino acid positions according to reference SEQ ID NO: 1). Accordingly, the antigenic peptide or protein selected from or derived from SARS-CoV-2 spike protein comprises a L518V, L518I, L518A amino acid substitution.

In embodiments, the SARS-CoV-2 spike protein comprises an amino acid substitution at position L518, wherein the amino acids L518 is substituted with N (amino acid positions according to reference SEQ ID NO: 1). Accordingly, the antigenic peptide or protein selected from or derived from SARS-CoV-2 spike protein comprises a L518V amino acid substitution.

In embodiments, the SARS-CoV-2 spike protein comprises an amino acid substitution at position E554, wherein the amino acids 554 is substituted with a different amino acid (amino acid positions according to reference SEQ ID NO: 1). Position E554 is frequently mutated in variant XBB.1.19.1.

Without wishing to be bound to theory, an amino acid substitution at position E554 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in E554 occurs on the coronavirus spike, where it may alter the shape of the protein, which may help to evade some types of coronavirus antibodies. Such SARS-CoV-2 are called SARS-CoV-2 E554 variants throughout the present invention and include e.g. XBB.1.19.1.

Accordingly, it may be advantageous that the RNA of the invention provides a SARS-CoV-2 spike protein comprising a substitution in position E554 to allow the induction of efficient immune responses against virus SARS-CoV-2 E554 variants.

In embodiments, the SARS-CoV-2 spike protein comprises an amino acid substitution at position E554, wherein the amino acids E554 is substituted with K, H, R (amino acid positions according to reference SEQ ID NO: 1).

Accordingly, the antigenic peptide or protein selected from or derived from SARS-CoV-2 spike protein comprises a E554K, E554H, E554R amino acid substitution.

In embodiments, the SARS-CoV-2 spike protein comprises an amino acid substitution at position E554, wherein the amino acids E554 is substituted with N (amino acid positions according to reference SEQ ID NO: 1). Accordingly, the antigenic peptide or protein selected from or derived from SARS-CoV-2 spike protein comprises a E554K amino acid substitution.

In preferred embodiments, the SARS-CoV-2 spike protein comprises an amino acid substitution at position T572, wherein the amino acids 572 is substituted with a different amino acid (amino acid positions according to reference SEQ ID NO: 1). Position T572 is frequently mutated in variant XBB.1.5.44.

Without wishing to be bound to theory, an amino acid substitution at position T572 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in T572 occurs on the coronavirus spike, where it may alter the shape of the protein, which may help to evade some types of coronavirus antibodies. Such SARS-CoV-2 are called SARS-CoV-2 T572 variants throughout the present invention and include e.g. XBB.1.5.44.

Accordingly, it may be advantageous that the RNA of the invention provides a SARS-CoV-2 spike protein comprising a substitution in position T572 to allow the induction of efficient immune responses against virus SARS-CoV-2 T572 variants.

In embodiments, the SARS-CoV-2 spike protein comprises an amino acid substitution at position T572, wherein the amino acids T572 is substituted with I, V, L, A (amino acid positions according to reference SEQ ID NO: 1).

Accordingly, the antigenic peptide or protein selected from or derived from SARS-CoV-2 spike protein comprises a T572I, T572V, T572L, T572A amino acid substitution.

In embodiments, the SARS-CoV-2 spike protein comprises an amino acid substitution at position T572, wherein the amino acids T572 is substituted with I (amino acid positions according to reference SEQ ID NO: 1). Accordingly, the antigenic peptide or protein selected from or derived from SARS-CoV-2 spike protein comprises a T572I amino acid substitution.

In embodiments, the SARS-CoV-2 spike protein comprises an amino acid substitution at position Q675, wherein the amino acids 675 is substituted with a different amino acid (amino acid positions according to reference SEQ ID NO: 1). Position Q675 is frequently mutated in variant EL.1.

Without wishing to be bound to theory, an amino acid substitution at position Q675 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in Q675 occurs on the coronavirus spike, where it may alter the shape of the protein, which may help to evade some types of coronavirus antibodies. Such SARS-CoV-2 are called SARS-CoV-2 Q675 variants throughout the present invention and include e.g. EL.1.

Accordingly, it may be advantageous that the RNA of the invention provides a SARS-CoV-2 spike protein comprising a substitution in position Q675 to allow the induction of efficient immune responses against virus SARS-CoV-2 Q675 variants.

In embodiments, the SARS-CoV-2 spike protein comprises an amino acid substitution at position K182, wherein the amino acids Q675 is substituted with H, R, K (amino acid positions according to reference SEQ ID NO: 1). Accordingly, the antigenic peptide or protein selected from or derived from SARS-CoV-2 spike protein comprises a Q675H, Q675R, Q675K amino acid substitution.

In embodiments, the SARS-CoV-2 spike protein comprises an amino acid substitution at position K182, wherein the amino acids Q675 is substituted with H (amino acid positions according to reference SEQ ID NO: 1). Accordingly, the antigenic peptide or protein selected from or derived from SARS-CoV-2 spike protein comprises a Q675H amino acid substitution.

In embodiments, the SARS-CoV-2 spike protein comprises an amino acid substitution at position D1153, wherein the amino acids 1153 is substituted with a different amino acid (amino acid positions according to reference SEQ ID NO: 1). Position D1153 is frequently mutated in variant XAY-1.1.1.

Without wishing to be bound to theory, an amino acid substitution at position D1153 may help SARS-CoV-2 virus variants to evade antibody detection of some types of antibodies induced in subjects vaccinated with first generation vaccines (designed e.g. against the original SARS-CoV-2 strain) or induced in subjects after infection with the original SARS-CoV-2 strain. A mutation/substitution in D1153 occurs on the coronavirus spike, where it may alter the shape of the protein, which may help to evade some types of coronavirus antibodies. Such SARS-CoV-2 are called SARS-CoV-2 D1153 variants throughout the present invention and include e.g. XAY-1.1.1.

Accordingly, it may be advantageous that the RNA of the invention provides a SARS-CoV-2 spike protein comprising a substitution in position D1153 to allow the induction of efficient immune responses against virus SARS-CoV-2 D1153 variants.

In embodiments, the SARS-CoV-2 spike protein comprises an amino acid substitution at position D1153, wherein the amino acids D1153 is substituted with Y, F, W, M (amino acid positions according to reference SEQ ID NO: 1). Accordingly, the antigenic peptide or protein selected from or derived from SARS-CoV-2 spike protein comprises a D1153Y, D1153F, D1153W, D1153M amino acid substitution.

In embodiments, the SARS-CoV-2 spike protein comprises an amino acid substitution at position D1153, wherein the amino acids D1153 is substituted with Y (amino acid positions according to reference SEQ ID NO: 1). Accordingly, the antigenic peptide or protein selected from or derived from SARS-CoV-2 spike protein comprises a D1153Y amino acid substitution.

Accordingly, in embodiments, the first aspect of the invention relates to an RNA comprising at least one coding sequence encoding at least one antigenic peptide or protein from a SARS-CoV-2 spike protein or an immunogenic fragment or immunogenic variant thereof, wherein the SARS-CoV-2 spike protein comprises at least one amino acid substitution at positions selected from L368, K444, N460, and at least one further amino acid substitution at position selected from K417; L452; T478; E484; N501 and/or P681 (amino acid positions according to reference SEQ ID NO: 1.

In embodiments, the SARS-CoV-2 spike protein that is encoded by the RNA of the invention comprises a further amino acid substitution at position N501 as defined herein, preferably N501Y, and a further amino acid substitution at position E484 as defined herein, preferably E484K or E484R (amino acid positions according to reference SEQ ID NO: 1).

In embodiments, the SARS-CoV-2 spike protein that is encoded by the RNA of the invention comprises a further amino acid substitution at position L452 as defined herein, preferably L452R, and an amino acid substitution at position E484 as defined herein, preferably E484Q (amino acid positions according to reference SEQ ID NO: 1).

In embodiments, the SARS-CoV-2 spike protein comprises, in addition to the substitutions defined above (at positions E484, N501, L452 and optionally P681), at least one, in particular 1, 2, 3, 4, 5, 6, 7, 8, 9, or 10 additional amino acid substitution, insertion or deletion selected from List 3 or List 4.

In embodiments, the SARS-CoV-2 spike protein that is encoded by the RNA of the invention comprises amino acid substitutions or deletions selected from any one of the amino acid substitutions or deletions according to List 4 and at least further amino acid substitutions or deletions selected from (relative to SEQ ID NO: 1):

K986P, V987P, A67V, H69del, V70del, T95I, G142D, V143del, Y144del, Y145del, N211del, L212I, ins214EPE, G339D, S371L, S373P, S375F, S477N, T478K, E484A, Q493R, G496S, Q498R, N501Y, Y505H, T547K, D614G, H655Y, N679K, P681H, N764K, D796Y, N856K, Q954H, N969K, L981F (SA, BA.1_v1);

K986P, V987P, A67V, H69del, V70del, T95I, G142D, V143del, Y144del, Y145del, N211del, L212I, ins214EPE, G339D, S371L, S373P, S375F, K417N, N440K, G446S, S477N, T478K, E484A, Q493R, G496S, Q498R, N501Y, Y505H, T547K, D614G, H655Y, N679K, P681H, N764K, D796Y, N856K, Q954H, N969K, L981F (SA, BA.1_v0);

K986P, V987P, A67V, T95I, G339D, S371L, S373P, S375F, S477N, T478K, E484A, Q493R, G496S, Q498R, N501Y, Y505H, T547K, D614G, H655Y, N679K, P681H, D796Y, N856K, Q954H, N969K, L981F (SA, B.1.1.529);

K986P, V987P, T19I, L24del, P25del, P26del, A27S, G142D, V213G, G339D, S371F, S373P, S375F, T376A, D405N, S477N, T478K, E484A, Q493R, Q498R, N501Y, Y505H, D614G, H655Y, N679K, P681H, D796Y, Q954H, N969K (SA, BA.2);

K986P, V987P, A67V, H69del, V70del, T95I, G142D, V143del, Y144del, Y145del, N211del, L212I, ins214EPE, G339D, S371L, S373P, S375F, N440K, S477N, T478K, E484A, Q493R, G496S, Q498R, N501Y, Y505H, T547K, D614G, H655Y, N679K, P681H, N764K, D796Y, N856K, Q954H, N969K, L981F (SA, BA.1_v2);

K986P, V987P, A67V, H69del, V70del, T95I, G142D, V143del, Y144del, Y145del, N211del, L212I, ins214EPE, G339D, S371L, S373P, S375F, S477N, T478K, E484A, Q493R, G496S, Q498R, N501Y, Y505H, T547K, D614G, H655Y, N679K, P681H, D796Y, N856K, Q954H, N969K, L981F (SA, BA.1_v3);

K986P, V987P, A67V, H69del, V70del, T95I, G142D, V143del, Y144del, Y145del, N211del, L212I, ins214EPE, G339D, S371L, S373P, S375F, S477N, T478K, E484A, Q493R, G496S, Q498R, N501Y, Y505H, T547K, D614G, H655Y, N679K, P681H, A701V, N764K, D796Y, N856K, Q954H, N969K, L981F (SA, BA.1_v4);

K986P, V987P, A67V, H69del, V70del, T95I, G142D, V143del, Y144del, Y145del, N211del, L212I, ins214EPE, G339D, S371L, S373P, S375F, G446S, S477N, T478K, E484A, Q493R, G496S, Q498R, N501Y, Y505H, T547K, D614G, H655Y, N679K, P681H, N764K, D796Y, N856K, Q954H, N969K, L981F (SA, BA.1_v5);
E484K, N501Y, L18F, D80A, D215G, L242del, A243del, L244del, R246I, K417N, D614G, and A701V; (SA; B.1.351)
E484K, N501Y, L18F, D80A, D215G, L242del, A243del, L244del, K417N, D614G, and A701V; (SA; B.1.351)
E484K, N501Y, L18F, T20N, P26S, D138Y, R190S, K417T, D614G, H655Y, and T1027I; (Brazil; P1)
E484K, N501Y, L18F, T20N, P26S, D138Y, R190S, K417T, D614G, H655Y, T1027I, and V1176F; (Brazil P1)
L452R, P681R, and D614G; (B.1.617.1; India)
L452R, E484Q, P681R, E154K, D614G, and Q1071H; (B.1.617.2; India)
L452R, P681R, T19R, F157del, R158del, T478K, D614G, and D950N; (B.1.617.2; India)
T19R, L452R, E484Q, D614G, P681R and D950N; (B.1.617.3; India)
G75V, T76I, S247del, Y248del, L249del, T250del, P251del, G252del, D253del, L452Q, F490S, D614G, and T859N; (C.37.1; Peru)
T95I, Y145N, R346K, E484K, N501Y, D614G, P681H, and D950N; (B.1.1.621)
T95I, Y144T, Y145S, ins145N, R346K, E484K, N501Y, D614G, P681H, and D950N; (B.1.1.621)
H69del, V70del, Y144del, E484K, N501Y, A570D, D614G, P681H, T716I, S982A, and D1118H; (B.1.1.7-E484K)
S13I, W152C, L452R, and D614G; (B.1.429)
L452R; and D614G; (B.1.429)
H69del; V70del; N439K; D614G; (B.1.258)
T95I; E484K; D614G; and A701V; (B.1.526)
L5F, T95I, D253G, E484K, D614G, and A701V; (B.1.526)
L5F, T95I, D253G, S477N, D614G, and Q957R; (B.1.526)
F157L; V367F; Q613H; and P681R (A.23.1)
S254F; D614G; P681R; and G769V (A.23.1)
T478K; D614G; P681H; and T732A (B.1.1.519; Mexico)
P26S, H69del, V70del, V126A, Y144del, L242del, A243del, L244del, H245Y, S477N, E484K, D614G, P681H, T1027I and D1118H; (B.1.620; Africa)
ins214TDR, Q414K, N450K, D614G, and T716I; (B.1.214.2)
S12F, H69del, V70del, W152R, R346S, L452R, D614G, Q677H and A899S; (C.36.3; Thailand)
E484K, D614G and V1176F; (P2)
Q52R; A67V; H69del; V70del; F157del; R158del; E484K; D614G; Q677H and F888L; (B.1.525)
Q52R; A67V; H69del; V70del; Y144del; E484K; D614G; Q677H and F888L; (B.1.525)
A67V; H69del; V70del; Y144del; E484K; D614G; Q677H and F888L; (B.1.525)
T19R; T95I; G142D, E156G, F157del; R158del; W258L; K417N; L452R; T478K; K558N, D614G; P681R; and D950N; (AY.1)
T19R; V70F; G142D, E156G, F157del; R158del; A222V, K417N; L452R; T478K; D614G; P681R; and D950N; (AY.2)
T19R; T95I; F157del; R158del; W258L; K417N; L452R; T478K; D614G; P681R; and D950N; or (AY.1)
T19R; V70F; F157del; R158del; A222V; K417N; L452R; T478K; D614G; P681R; and D950N; (AY.2)
H69del, V70del and D614G;
D614G and M1229I;
A222V and D614G;
S477N and D614G;
N439K and D614G;
H69del, V70del, Y453F, D614G and I692I;
Y453F and D614G;
D614G and I692V;
H69del, V70del, A222V, Y453F, D614G and I692I;
N501Y and D614G;
K417N; E484K; N501Y and D614G;
D614G;
R346T
L452R
D614G, and R346T
D614G, and L452R; or
E484K and D614G.

In some embodiments, a fragment of a spike protein (S) as defined herein may be encoded by the RNA of the invention, wherein said fragment may be N-terminally truncated, lacking the N-terminal amino acids 1 to up to 100 of the full length SARS-CoV-2 variant protein and/or wherein said fragment may be C-terminally truncated, lacking the C-terminal amino acids (aa) 531 to up to aa 1273 of the full length SARS-CoV-2 variant protein. Such "fragment of a spike protein (S)" may additionally comprise amino acid substitutions (as described herein) and may additionally comprise at least one heterologous peptide or protein element (as described herein). In preferred embodiments, a fragment of a spike protein (S) may be C-terminally truncated, thereby lacking the C-terminal transmembrane domain (that is, lacking aa 1212 to aa 1273 or lacking aa 1148 to aa 1273) (amino acid positions according to reference SEQ ID NO: 1).

In other embodiments, the encoded spike protein (S) derived from SARS-CoV-2 lacks the transmembrane domain (TM) (amino acid position aa 1212 to aa 1273 according to reference SEQ ID NO: 1). In embodiments, the encoded spike protein (S) derived from SARS-CoV-2 lacks an extended part of the transmembrane domain (TMflex) (amino acid position aa 1148 to aa 1273 according to reference SEQ ID NO: 1). Without wishing to being bound to theory, a spike protein (S) lacking the transmembrane domain (TM or TMflex) as defined herein could be suitable for a vaccine, as such a protein would be soluble and not anchored in the cell membrane. A soluble protein may therefore be produced (that is translated) in higher concentrations upon administration to a subject, leading to improved immune responses.

Without wishing to being bound to theory, RBD (aa 319 to aa 541) and CND (aa 329 to aa 529) domains, as referenced for amino acid positions with SEQ ID NO:1, may be crucial for immunogenicity. Both regions are located at the S1 fragment of the spike protein. Accordingly, it may be suitable in the context of the invention that the antigenic peptide or protein comprises or consists of an S1 fragment of the spike protein or an immunogenic fragment or immunogenic variant thereof. Suitably, such an S1 fragment may comprise at least an RBD and/or a CND domain as defined above. In some embodiments, the immunogenic fragment of such an S1 fragment is at least 80%, 85%, 90%, or 95% identical to over the whole S1 sequence on protein level. In further embodiments, the immunogenic fragment of such an S1 fragment is at least 80%, 85%, 90%, or 95% identical to over the whole S1 sequence on RNA level.

In some embodiments, the immunogenic variant of such an S1 fragment is at least 80%, 85%, 90%, or 95% identical to over the whole S1 sequence on protein level. In further embodiments, the immunogenic variant of such an S1 fragment is at least 80%, 85%, 90%, or 95% identical to over the whole S1 sequence on RNA level.

In embodiments, the encoded at least one antigenic peptide or protein comprises or consists of a receptor-binding domain (RBD; aa 319 to aa 541), wherein the RBD comprises or consists of a spike protein fragment, or an immunogenic fragment or immunogenic variant thereof.

In further embodiments, the encoded at least one antigenic peptide or protein comprises or consists of a truncated receptor-binding domain (truncRBD; aa 334 to aa 528), wherein the RBD comprises or consists of a spike protein fragment, or an immunogenic fragment or immunogenic variant thereof.

Such "fragment of a spike protein (S)" (RBD; aa 319 to aa 541 or truncRBD, aa 334 to aa 528), may additionally comprise amino acid substitutions (as described herein) and may additionally comprise at least one heterologous peptide or protein element (as described herein).

In embodiments, the encoded at least one antigenic peptide or protein comprises or consists of a spike protein (S), wherein the spike protein (S) comprises or consists of a spike protein fragment S1, or an immunogenic fragment or immunogenic variant thereof.

In embodiments, the encoded at least one antigenic peptide or protein comprises a spike protein fragment S1, and lacks at least 70%, 80%, 81%, 82%, 83%,84%, 85%, 86%, 87%, 88%, 89%, 90%, 91%, 92%, 93%, 94%, 95%, 96%, 97%, 98%, 99% or 100% of spike protein fragment S2 (aa 682 to aa 1273). Such embodiments may be beneficial, as the S1 fragment comprises neutralizing epitopes.

Without wishing to being bound to theory, it may be suitable that the antigenic peptide or protein comprises or consists of spike protein fragment S1 and (at least a fragment of) spike protein fragment S2, because the formation of an immunogenic spike protein may be promoted.

Accordingly, in embodiments, the encoded at least one antigenic peptide or protein comprises or consists of a spike protein (S), wherein the spike protein (S) comprises or consists of a spike protein fragment S1 or an immunogenic fragment or immunogenic variant thereof, and spike protein fragment S2 or an immunogenic fragment or immunogenic variant thereof.

In alternative embodiments, the encoded at least one antigenic peptide or protein comprises or consists of a full-length spike protein or an immunogenic fragment or immunogenic variant of any of these.

The term "full length spike protein" has to be understood as a spike protein derived from a SARS-CoV-2 having an amino acid sequence corresponding to essentially the full spike protein. Accordingly, a "full length spike protein" may comprise aa 1 to aa 1273 (reference protein: SEQ ID NO: 1). Accordingly, a full length spike protein may typically comprise a secretory signal peptide, a spike protein fragment S1, a spike protein fragment S2, a receptor binding domain (RBD), and a critical neutralisation domain CND, and a transmembrane domain. Notably, also variants that comprise certain amino acid substitutions (e.g. for allowing pre-fusion stabilization of the S protein) or natural occurring amino acid deletions are encompassed by the term "full length spike protein".

In embodiments, the spike protein (S) that is encoded by the RNA of the first aspect is designed or adapted to stabilize the antigen in pre-fusion conformation. A pre-fusion conformation is particularly advantageous in the context of an efficient coronavirus vaccine, as several potential epitopes for neutralizing antibodies may merely be accessible in said pre-fusion protein conformation. Furthermore, remaining of the protein in the pre-fusion conformation is aimed to avoid immunopathological effects, like e.g. enhanced disease and/or antibody dependent enhancement (ADE).

In embodiments, administration of the RNA (or a composition or vaccine) encoding pre-fusion stabilized spike protein to a subject elicits spike protein neutralizing antibodies and does not elicit disease-enhancing antibodies. In particular, administration of a nucleic acid (or a composition or vaccine) encoding pre-fusion stabilized spike protein to a subject does not elicit immunopathological effects, like e.g. enhanced disease and/or antibody dependent enhancement (ADE).

Accordingly, in embodiments, the RNA of the invention comprises at least one coding sequence encoding at least one antigenic peptide or protein that is selected or is derived from a SARS-CoV-2 spike protein (S), wherein the SARS-CoV-2 spike protein (S) is a pre-fusion stabilized spike protein (S_stab). Suitably, said pre-fusion stabilized spike protein comprises at least one pre-fusion stabilizing mutation.

The term "pre-fusion conformation" as used herein relates to a structural conformation adopted by the ectodomain of the SARS-CoV-2 S protein following processing into a mature SARS-CoV-2 S protein in the secretory system, and prior to triggering of the fusogenic event that leads to transition of the SARS-CoV-2 S to the postfusion conformation.

A "pre-fusion stabilized spike protein (S_stab)" as described herein comprises one or more amino acid substitutions, deletions, or insertions compared to a native SARS-CoV-2 S sequence that provide for increased retention of the prefusion conformation compared to SARS-CoV-2 S ectodomain trimers formed from a corresponding native SARS-CoV-2 S sequence. The "stabilization" of the prefusion conformation by the one or more amino acid substitutions, deletions, or insertions can be, for example, energetic stabilization (for example, reducing the energy of the pre-fusion conformation relative to the post-fusion open conformation) and/or kinetic stabilization (for example, reducing the rate of transition from the prefusion conformation to the postfusion conformation). Additionally, stabilization of the SARS-CoV-2 S ectodomain trimer in the prefusion conformation can include an increase in resistance to denaturation compared to a corresponding native SARS-CoV-2 S sequence.

Accordingly, in embodiments, the SARS-CoV-2 spike protein includes one or more amino acid substitutions that stabilize the S protein in the pre-fusion conformation, for example, substitutions that stabilize the membrane distal portion of the S protein (including the N-terminal region) in the pre-fusion conformation.

Stabilization of the SARS-CoV-2 coronavirus spike protein may be obtained by substituting at least one amino acid at position K986 and/or V987 with amino acids that stabilize the spike protein in a prefusion conformation (amino acid positions according to reference SEQ ID NO: 1).

In embodiments, the pre-fusion stabilizing mutation comprises an amino acid substitution at position K986 and V987, wherein the amino acids K986 and/or V987 are substituted with an amino acid selected from A, I, L, M, F, V, G, or P (amino acid positions according to reference SEQ ID NO: 1).

In embodiments, stabilization of the prefusion conformation is obtained by introducing two consecutive proline substitutions at residues K986 and V987 in the spike protein (amino acid positions according to reference SEQ ID NO: 1).

Accordingly, in preferred embodiments, the pre-fusion stabilized spike protein (S_stab) comprises at least one pre-fusion stabilizing mutation, wherein the at least one pre-fusion stabilizing mutation comprises the following amino acid substitutions: K986P and V987P (amino acid positions according to reference SEQ ID NO: 1).

In preferred embodiments, the SARS-CoV-2 spike protein that is encoded by the RNA of the invention is a pre-fusion stabilized spike protein (S_stab) comprising at least one pre-fusion stabilizing K986P and V987P mutation and additionally comprising the amino acid substitutions or deletions according to the invention (see therefore List 1, List 2, List 3, and List 4) (amino acid positions according to reference SEQ ID NO: 1).

In preferred embodiments, the SARS-CoV-2 spike protein that is encoded by the RNA of the invention is a pre-fusion stabilized spike protein (S_stab) (or a fragment or variant thereof) comprising at least one pre-fusion stabilizing K986P and V987P mutation and additionally comprises at least the amino acid substitutions, deletions or insertions at the positions corresponding to (amino acid positions according to reference SEQ ID NO: 1):

N460 and F490;
N460, R346 and F490;
N460, R346, F490 and Y144;
N460, and D614;
N460, D614, and L452;
N460, K444, and R346;
N460, K444, and Y144;
T604 and L452;
K444, A1020, and D614;
N460, F486 and F490,
N460, F486, R346 and F490,
N460, F486, R346, F490 and Y144,
N460, F486, and D614,
P209 and L452,
P209 and D614,
P209 and Y144,
P209, L452 and Y144,
S256 and L452,
S256 and D164,
S256 and Y144,
S256, L452 and Y144,
P209, S256 and L452,
P209, S256 and D164,
P209, S256 and Y144,
P209, S256, L452 and Y144,
K356 and F490,
K356 and R346,
K356 and D614,
K356, F490 and R346,
K356, F490, R346 and D614,
I666 and F490,
I666 and R346,
I666 and D614,
I666, F490 and R346,
I666, F490, R346 and D614,
N460, I666 and F490,
N460, I666 and R346,
N460, I666 and D614,
N460, I666, F490 and R346,
N460, I666, F490, R346 and D614,
N164 and K444,
N164 and L452,
N164 and D614,
N164, K444 and L452,
N164, K444, L452 and D614,
N460, N164 and K444,
N460, N164 and L452,
N460, N164 and D614,
N460, N164, K444 and L452,
N460, N164, K444, L452 and D614,
N460 and E180,
N460 and D215,
N460 and P521,
N460 and D80,
N460 and G184,
N460 and N185,
N460 and T881,
N460 and E1144,
N460 and Q613,
N460, D215 and Q613,
N460 and K182,
N460 and Y200,
N460 and Q615,
N460 and L518,
N460 and E554,
N460 and T572,
N460, K182, R346, and F490,
N460, Y200, R346, and F490,
N460, Q615, R346, and F490,
N460, L518, R346, and F490,
N460, E554, R346, and F490,
N460, T572, R346, and F490,
N460, K182, R346, F490 and Y144,
N460, Y200, R346, F490 and Y144,
N460, Q615, R346, F490 and Y144,
N460, L518, R346, F490 and Y144,
N460, E554, R346, F490 and Y144,
N460, T572, R346, F490 and Y144,
N460, K182 and D614,
N460, Y200 and D614,
N460, Q615 and D614,
N460, L518 and D614,
N460, E554 and D614,
N460, T572 and D614,
N460, K182 and F490,
N460, Y200 and F490,
N460, Q615 and F490,
N460, L518 and F490,
N460, E554 and F490,
N460, T572 and F490,
N460, K182, F486, R346, F490 and Y144,
N460, Y200, F486, R346, F490 and Y144,
N460, Q615, F486, R346, F490 and Y144,
N460, L518, F486, R346, F490 and Y144,
N460, E554, F486, R346, F490 and Y144,
N460, T572, F486, R346, F490 and Y144,
K182 and F490,
K182 and D614,
K182 and Y144,
K182 and F486,
K182 and R346,
Y200 and F490,
Y200 and D614,
Y200 and Y144,
Y200 and F486,
Y200 and R346,
Q615 and F490,
Q615 and D614,
Q615 and Y144,
Q615 and F486,
Q615 and R346,
L518 and F490, L518 and D614,
L518 and Y144,
L518 and F486,
L518 and R346,
E554 and F490,
E554 and D614,
E554 and Y144,
E554 and F486,
E554 and R346,
T572 and F490,
T572 and D614,
T572 and Y144,
T572 and F486,
T572 and R346,
K182, D614 and F490,
K182, D614 and Y144,
K182, D614 and F486,
K182, D614 and R346,
Y200, D614 and F490,
Y200, D614 and Y144,
Y200, D614 and F486,
Y200, D614 and R346,
Q615, D614 and F490,
Q615, D614 and Y144,
Q615, D614 and F486,
Q615, D614 and R346,
L518, D614 and F490,
L518, D614 and Y144,
L518, D614 and F486,
L518, D614 and R346,
E554, D614 and F490,
E554, D614 and Y144,
E554, D614 and F486,
E554, D614 and R346,
T572, D614 and F490,
T572, D614 and Y144,
T572, D614 and F486,
T572, D614 and R346,
D1153 and D614,
D1153 and F486,
D1153 and R346,
D1153 and L452,
D1153, D614 and F486,
D1153, D614 and R346,
D1153, D614 and L452,
D1153, D614, R346 and F486,
D1153, D614, R346 and L452,
D1153, D614, R346, F486 and L452.

In preferred embodiments, the SARS-CoV-2 spike protein that is encoded by the RNA of the invention is a pre-fusion stabilized spike protein (S_stab) (or a fragment or variant thereof) comprising at least one pre-fusion stabilizing K986P and V987P mutation and additionally comprises the following amino acid substitutions or deletions (amino acid positions according to reference SEQ ID NO: 1):

N460K and F490S,
N460K, R346T and F490S;
N460K, R346T, F490S and Y144del;
N460K, and D614G;
N460K, D614G, and L452R;
N460K, K444T, and R346T;
N460K, K444M, and Y144del;
N460K, G252V. and Y144del;
G339H and R346T;
F486S and R346T;
F486S, D1199N, and R346T;
N658S and R346T;
T604I and L452R,
K444M, A1020S, and D614G;
V83A, H146Q, Q183E, V213E, G252V, G339H, L368I, V445P, N460K, F486S, and F490S,
N460K, D614G, and F490S;
N460K, R346T, D614G, and F490S;
N460K, R346T, F490S, D614G, and Y144del;
N460K, D614G, and L452R;
N460K, K444T, D614G, and R346T;
N460K, K444M, D614G, and Y144del;
N460K, G252V, D614G, and Y144del;
G339H, D614G, and R346T;
F486S, D614G, and R346T,
F486S, D1199N, D614G, and R346T;
N658S, D614G, and R346T;
T604I, D614G, and L452R;
F486P and F490S;
F486P, R346T and F490S;
F486P, R346, F490 and Y144del;
F486P, and D614G;
N460K, F486P and F490S;
N460K, F486P, R346T and F490S;
N460K, F486P, R346T, F490S and Y144del;
N460K, F486P, and D614del;
P209L and L452M;
P209L and D614G;
P209L and Y144del;
P209L, L452M and Y144del;
S256L and L452M;
S256L and D164G;
S256L and Y144del;
S256L, L452M and Y144del;
P209L, S256L and L452M;
P209L, S256L and D164G;
P209L, S256L and Y144del;
P209L, S256L, L452M and Y144del;
K356T and F490S;
K356T and R346T;
K356T and D614G;
K356T, F490S and R346T;
K356T, F490S, R346T and D614G;
I666V and R346T;
I666V and D614G;
I666V, R346T and D614G;
N460K and I666V;
N460K, I666V and R346T;
N460K, I666V and D614G;
N164K and K444R;
N164K and L452M;
N164K and D614G;
N164K, K444R and L452M;
N164K, K444R, L452M and D614G;
N460K, N164K and K444R;
N460K, N164K and L452M;
N460K, N164K and D614G;
N460K, N164K, K444R and L452M;
N460K, N164K, K444R, L452M and D614G;
N460K and E180V,
N460K and D215H,
N460K and P521S,
N460K and D80Y,
N460K and G184V,
N460K and N185D,
N460K and T883I,
N460K and E1144Q,
N460K and Q613H,
N460K, D215G and Q613H, N460K and K182N,
N460K and Y200C,
N460K and Q615H,
N460K and L518V,
N460K and E554K,
N460K and T572I,
N460K, K182N and D614G,
N460K, Y200C and D614G,
N460K, Q615H and D614G,
N460K, L518V and D614G,
N460K, E554K and D614G,
N460K, T572I and D614G,
N460K, K182N and F490S,
N460K, Y200C and F490S,
N460K, Q615H and F490S,
N460K, L518V and F490S,
N460K, E554K and F490S,
N460K, T572I and F490S,
N460K, K182N, R346T, and F490S,
N460K, Y200C, R346T, and F490S,
N460K, Q615H, R346T, and F490S,
N460K, L518V, R346T, and F490S,
N460K, E554K, R346T, and F490S,
N460K, T572I, R346T, and F490S,
N460K, K182N, R346T, F490S and Y144del,
N460K, Y200C, R346T, F490S and Y144del,
N460K, Q615H, R346T, F490S and Y144del,
N460K, L518V, R346T, F490S and Y144del,
N460K, E554K, R346T, F490S and Y144del,
N460K, T572I, R346T, F490S and Y144del,
K182N and F490S,
K182N and D614G,
K182N and Y144del,
K182N and F486S,
K182N and R346T,
Y200C and F490S,
Y200C and D614G,
Y200C and Y144del,
Y200C and F486S,
Y200C and R346T,
N460K, K182N, F486P, R346T, F490S and Y144del,
N460K, Y200C, F486P, R346T, F490S and Y144del,
N460K, Q615H, F486P, R346T, F490S and Y144del,
N460K, L518V, F486P, R346T, F490S and Y144del,
N460K, E554K, F486P, R346T, F490S and Y144del,
N460K, T572I, F486P, R346T, F490S and Y144del,
K182N and F490S,
K182N and D614G,
K182N and Y144del,
K182N and F486S,
K182N and R346T,
Y200C and F490S,
Y200C and D614G,
Y200C and Y144del,
Y200C and F486S,
Y200C and R346T,
K182N, D614G and F490S,
K182N, D614G and Y144del,
K182N, D614G and F486S,
K182N, D614G and R346T,
Y200C, D614G and F490S,
Y200C, D614G and Y144del,
Y200C, D614G and F486S,
Y200C, D614G and R346T,
Q615H, D614G and F490S,
Q615H, D614G and Y144del,
Q615H, D614G and F486S,
Q615H, D614G and R346T,
L518V, D614G and F490S,
L518V, D614G and Y144del,
L518V, D614G and F486S,
L518V, D614G and R346T,
E554K, D614G and F490S,
E554K, D614G and Y144del,
E554K, D614G and F486S,
E554K, D614G and R346T,
T572I, D614G and F490S,
T572I, D614G and Y144del,
T572I, D614G and F486S,
T572I, D614G and R346T,
D1153Y and D614G,
D1153Y and F486S,
D1153Y and R346T,
D1153Y and L452R,
D1153Y, D614G and F486S,
D1153Y, D614G and R346T,
D1153Y, D614G and L452R,
D1153Y, D614G, R346T and F486S,
D1153Y, D614G, R346T and L452R,
D1153Y, D614G, R346T, F486S and L452R,
V83A, H146Q, Q183E, V213E, G252V, G339H, L368I, V445P, N460K, F486P, D614G, and F490S or
V83A, H146Q, Q183E, V213E, G252V, G339H, L368I, V445P, N460K, F486S, D614G, and F490S.

In embodiments, the SARS-CoV-2 spike protein that is encoded by the RNA of the invention is a pre-fusion stabilized spike protein (S_stab) (or a fragment or variant thereof) comprising at least one pre-fusion stabilizing K986P and V987P mutation and additionally comprises the following amino acid substitutions or deletions (amino acid positions according to reference SEQ ID NO: 1):

T19I, L24del, P25del, P26del, A27S, H69del, V70del, G142D, V213G, G339D, R346T, S371F, S373P, S375F, T376A, D405N, R408S, K417N, N440K, K444T, L452R, N460K, S477N, T478K, E484A, F486V, Q498R, N501Y, Y505H, D614G, H655Y, N679K, P681H, N764K, D796Y, Q954H, N969K (BQ.1.1);

T19I, L24del, P25del, P26del, A27S, H69del, V70del, G142D, V213G, G339D, S371F, S373P, S375F, T376A, D405N, R408S, K417N, N440K, K444T, L452R, N460K, S477N, T478K, E484A, F486V, Q498R, N501Y, Y505H, D614G, H655Y, I666V, N679K, P681H, N764K, D796Y, Q954H, N969K (BQ.1.2);

T19I, L24del, P25del, P26del, A27S, H69del, V70del, G142D, Y144del, V213G, G339D, R346T, S371F, S373P, S375F, T376A, D405N, R408S, K417N, N440K, K444T, L452R, N460K, S477N, T478K, E484A, F486V, Q498R, N501Y, Y505H, D614G, H655Y, N679K, P681H, N764K, D796Y, Q954H, N969K (BQ.1.18);

T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486S, F490S, Q498R, N501Y, Y505H, D614G, H655Y, N679K, P681H, N764K, D796Y, Q954H, N969K (XBB.1);

T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R,

N501Y, Y505H, D614G, H655Y, N679K, P681H, N764K, D796Y, Q954H, N969K (XBB.1.5);

T19I, L24del, P25del, P26del, A27S, V83A, G142D, E180V, Y144del, H146Q, Q183E, V213E, G252V, G339H, R346T, L368I, S371F, S373P, S375F, T376A, D405N, R408S, K417N, N440K, V445P, G446S, N460K, S477N, T478R, E484A, F486P, F490S, Q498R, N501Y, Y505H, D614G, H655Y, N679K, P681H, N764K, D796Y, Q954H, N969K (XBB.1.16);

T19I, L24del, P25del, P26del, A27S, V83A, G142D, E180V, Y144del, H146Q, Q183E, V213E, G252V, G339H, R346T, L368I, S371F, S373P, S375F, T376A, D405N, R408S, K417N, N440K, V445P, G446S, N460K, S477N, T478R, E484A, F486P, F490S, Q498R, N501Y, Y505H, T547I D614G, H655Y, N679K, P681H, N764K, D796Y, Q954H, N969K (XBB.1.16.1);

T19I, L24del, P25del, P26del, A27S, V83A, G142D, Y144del, H146Q, Q183E, V213E, D215H, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, N764K, D796Y, Q954H, N969K (XBB.1.17.1);

T19I, L24del, P25del, P26del, A27S, V83A, G142D, Y144del, H146Q, Q183E, V213E, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, N764K, D796Y, Q954H, N969K (XBB.1.22);

T19I, L24del, P25del, P26del, A27S, V83A, G142D, Y144del, H146Q, Q183E, V213E, D253G, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, P521S, D614G, H655Y, N679K, P681H, N764K, D796Y, Q954H, N969K (XBB.2.3);

T19I, L24del, P25del, P26del, A27S, D80Y, V83A, G142D, Y144del, H146Q, Q183E, V213E, D253G, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, P521S, D614G, H655Y, N679K, P681H, N764K, D796Y, Q954H, N969K (XBB.2.3.1);

T19I, L24del, P25del, P26del, A27S, V83A, G142D, Y144del, H146Q, Q183E, G184V, V213E, D253G, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, P521S, D614G, H655Y, N679K, P681H, N764K, D796Y, Q954H, N969K (XBB.2.3.2);

L18F, T19R, R21G, T95I, W152L, E156G, F157del, R158del, F186L, V213G, G339D, S371F, S373P, S375F, T376A, D405N, R408S, K417N, N440K, G446D, S477N, L452R T478K, E484A, F486P, Q498R, N501Y, Y505H, D614G, P621S, H655Y, N679K, P681H, A706V N764K, D796Y, Q954H, N969K, T1117I (XAY-2);

T19I, L24del, P25del, P26del, A27S, V83A, G142D, Y144del, H146K, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, N764K, D796Y, Q954H, N969K (FD.2);

T19I, P25S, G142D, Y144del, E156G, F157del, R158del, P209L, L212S, D215H, A222V, A243del, L244del, S371F, S373P, S375F, T376A, D405N, R408S, K417N, N440K, G446S, L452M, S477N, T478K, E484A, F486P, Q498R, N501Y, Y505H, D614G, H655Y, N679K, P681H, N703I, N764K, D796Y, Q954H, N969K (XBC.1);

T19I, P25S, K97R, G142D, Y144del, E156G, F157del, R158del, P209L, L212S, D215H, A222V, A243del, L244del, S371F, S373P, S375F, T376A, D405N, R408S, K417N, N440K, G446S, S477N, T478K, E484A, F486P, Q498R, N501Y, Y505H, D614G, H655Y, N679K, P681H, N703I, N764K, D796Y, Q954H, N969K (XBC.2);

T19I, L24del, P25del, P26del, A27S, G142D, K147E, W152R, F157L, I210V, V213G, G257S, G339H, R346T, S371F, S373P, S375F, T376A, D405N, R408S, K417N, N440K, G446S, N460K, S477N, T478K, E484A, F486P, F490S, Q498R, N501Y, Y505H, D614G, H655Y, N679K, P681H, N764K, D796Y, Q954H, N969K (XBF);

T19I, L24del, P25del, P26del, A27S, G142D, M153T, N164K, V213G, H245N, G257D, G339D, S371F, S373P, S375F, T376A, D405N, R408S, K417N, N440K, K444R, N450D, L452M, N460K, S477N, T478K, E484R, Q498R, N501Y, Y505H, D614G, H655Y, N679K, P681H, N764K, D796Y, Q954H, N969K (CM.2);

T19I, L24del, P25del, P26del, A27S, G142D, K147E, W152R, F157L, I210V, V213G, G257S, G339H, R346T, K356T, S371F, S373P, S375F, T376A, D405N, R408S, K417N, N440K, G446S, N460K, S477N, T478K, E484A, F490S, Q498R, N501Y, Y505H, D614G, H655Y, N679K, P681H, N764K, D796Y, Q954H, N969K (BN.1);

T19I, L24del, P25del, P26del, A27S, H69del, V70del, G142D, V213G, G339D, S371F, S373P, S375F, T376A, D405N, R408S, K417N, N440K, L452R, S477N, T478K, E484A, F486V, Q498R, N501Y, Y505H, D614G, H655Y, N679K, P681H, N764K, D796Y, Q954H, N969K, A1020S (BF.5);

T19I, L24del, P25del, P26del, A27S, G142D, K147E, W152R, F157L, I210V, V213G, G257S, G339H, S371F, S373P, S375F, T376A, D405N, R408S, K417N, N440K, G446S, N460K, S477N, T478K, E484A, Q498R, N501Y, Y505H, D614G, H655Y, N679K, P681H, N764K, D796Y, Q954H, N969K (BA.2.75);

T19I, L24del, P25del, P26del, A27S, G142D, K147E, W152R, F157L, I210V V213G, G257S, G339H, S371F, S373P, S375F, T376A, D405N, R408S, K417N, N440K, G446S, N460K, S477N, T478K, E484A, Q498R, N501Y, Y505H, D574V, D614G, H655Y, N679K, P681H, N764K, D796Y, Q954H, N969K (BA.2.75.1);

T19I, L24del, P25del, P26del, A27S, G142D, K147E, W152R, F157L, I210V, V213G, G257S, G339H, R346T, S371F, S373P, S375F, T376A, D405N, R408S, K417N, N440K, G446S, N460K, S477N, T478K, E484A, F486S, Q498R, N501Y, Y505H, D614G, H655Y, N679K, P681H, N764K, D796Y, Q954H, N969K, D1199N (BA.2.75.2);

T19I, L24del, P25del, P26del, A27S, G142D, K147E, W152R, F157L, I210V, V213G, G257S, G339H, R346T, S371F, S373P, S375F, T376A, D405N, R408S, K417N, N440K, G446S, N460K, S477N, T478K, E484A, F486S, Q498R, N501Y, Y505H, D614G, H655Y, N679K, P681H, N764K, D796Y, Q954H, N969K (BM1.1);

T19I, L24del, P25del, P26del, A27S, G142D, K147E, W152R, F157L, I210V, V213G, G257S, G339H, R346T, S371F, S373P, S375F, T376A, D405N, R408S, K417N, N440K, G446S, N460K, S477N, T478K, E484A, F486S, F490S, Q498R, N501Y, Y505H, D614G, H655Y, N679K, P681H, N764K, D796Y, Q954H, N969K (BM.1.1.1);

T19I, L24del, P25del, P26del, A27S, G142D, K147E, W152R, F157L, I210V, V213G, G257S, G339H, R346T, S371F, S373P, S375F, T376A, D405N, R408S, K417N, N440K, G446S, L452R, N460K, S477N, T478K, E484A, F486S, Q498R, N501Y, Y505H, T604I, D614G, H655Y, N679K, P681H, N764K, D796Y, Q954H, N969K, D1199N (CA.1);

T19I, L24del, P25del, P26del, A27S, H69del, V70del, G142D, Y144del, V213G, G339D, S371F, S373P, S375F, T376A, D405N, R408S, K417N, N440K, K444M, L452R, N460K, S477N, T478K, E484A, F486V, Q498R, N501Y, Y505H, D614G, H655Y, N679K, P681H, N764K, D796Y, Q954H, N969K (BU.1);

T19I, L24del, P25del, P26del, A27S, V83A, G142D, Y144del, H146Q, Q183E, V213E, G339H, R346T, L368I, S371F, S373P, S375F, T376A, D405N, R408S, K417N, N440K, V445P, G446S, S477N, T478K, V483A, E484A, F490V, Q493R, Q498R, N501Y, Y505H, D614G, H655Y, N679K, P681H, N764K, D796Y, G798D, Q954H, N969K, S1003I (BJ.1);

T19I, L24del, P25del, P26del, A27S, V83A, G142D, Y144del, H146Q, Q183E, V213E, G339H, R346T, L368I, D405N, R408S, N440K, V445P, G446S, S477N, T478K, V483A, E484A, F490V, Q493R, Q498R, N501Y, Y505H, D614G, H655Y, N679K, P681H, N764K, D796Y, G798D, Q954H, N969K, S1003I (BJ.1.v1);

T19I, L24del, P25del, P26del, A27S, H69del, V70del, G142D, V213G, R346T, G339D, S371F, S373P, S375F, T376A, D405N, R408S, K417N, N440K, L452R, S477N, T478K, E484A, F486V, Q498R, N501Y, Y505H, D614G, H655Y, N679K, P681H, N764K, D796Y, Q954H, N969K (BF.7);

T19I, L24del, P25del, P26del, A27S, H69del, V70del, G142D, V213G, R346T, G339D, S371F, S373P, S375F, T376A, D405N, R408S, K417N, N440K, L452R, S477N, T478K, E484A, F486V, Q498R, N501Y, Y505H, D614G, H655Y, N679K, P681H, N764K, D796Y, Q954H, N969K, C1243F (BF.7.14);

T19I, L24del, P25del, P26del, A27S, G142D, K147E, W152R, F157L, I210V V213G, G257S, G339H, R346T S371F, S373P, S375F, T376A, D405N, R408S, K417N, N440K, K444T, G446S, N460K, L452R, S477N, T478K, E484A, F486S, Q498R, N501Y, Y505H, D614G, H655Y, N679K, P681H, N764K, D796Y, Q954H, N969K (CH.1.1);

T19I, L24del, P25del, P26del, A27S, G142D, K147E, W152R, F157L, N185D, I210V V213G, G257S, G339H, R346T S371F, S373P, S375F, T376A, D405N, R408S, K417N, N440K, K444T, G446S, N460K, L452R, S477N, T478K, E484A, F486S Q493R, Q498R, N501Y, Y505H, D614G, H655Y, N679K, P681H, N764K, D796Y, Q954H, N969K (CH.1.1.1);

T19I, L24del, P25del, P26del, A27S, G142D, K147E, W152R, F157L, I210V, V213G, G257S, G339H, R346T S371F, S373P, S375F, T376A, D405N, R408S, K417N, N440K, K444T, G446S, N460K, L452R, S477N, T478K, E484A, F486S Q493R, Q498R, N501Y, Y505H, D614G, H655Y, N679K, P681H, N764K, D796Y, T883I, Q954H, N969K (CH.1.1.2);

T19I, L24del, L25del, P26del, A27S, H69del, V70del, G142D, delY144, V213G, D253G, G339D, R346T, S371F, S373P, S375F, T376A, D405N, R408N, K417N, N440K, K444T, L452R, N460K, S477N, T478K, E484A, F486V, Q498R, N501Y, Y505H, D614G, H655Y, N679K, P681H, N764K, D796Y, Q954H, N969K, E1144Q (DU.1);

T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, Q613H, D614G, H655Y, N679K, P681H, N764K, D796Y, Q954H, N969K (EG1);

T19I, L24del, P25del, P26del, A27S, V83A, G142D, Y144del, H146Q, Q183E, V213E, G252V, G339H, R346T, L368I, S371F, S373P, S375F, T376A, D405N, R408S, I410V, K417N, N440K, V445P, G446S, N460K, S477N, T478K, E484A, F486P, F490S, Q498R, N501Y, Y505H, P521S, D614G, H655Y, N679K, P681H, N764K, D796Y, Q954H, N969K (EU.1.1);

T19I, L24del, P25del, P26del, A27S, G142D, K147E, W152R, F157L, I210V, V213G, D215G, G257S, G339H, R346T S371F, S373P, S375F, T376A, D405N, R408S, K417N, N440K, K444T, G446S, N460K, L452R, S477N, T478K, E484A, F486S, Q498R, N501Y, Y505H, Q613H, D614G, H655Y, N679K, P681H, N764K, D796Y, Q954H, N969K (FK.1);

T19I, P25S, G142D, Y144del, E156G, F157del, R158del, P209L, L212S, D215H, A222V, A243del, L244del, S256L, R346S, S371F, S373P, S375F, T376A, D405N, R408S, K417N, N440K, G446S, L452R, S477N, T478K, E484A, F486P, Q498R, N501Y, Y505H, D614G, H655Y, N679K, P681H, N703I, N764K, D796Y, Q954H, N969K (XBC.1.6);

T19I, L24del, P25del, P26del, A27S, Q52H, V83A, G142D, Y144del, H146Q, Q183E, V213E, G252V, G339H, R346T, L368I, S371F, S373P, S375F, T376A, D405N, R408S, K417N, N440K, V445P, G446S, F456L, N460K, S477N, T478K, E484A, F486P, F490S, Q498R, N501Y, Y505H, D614G, H655Y, N679K, P681H, N764K, D796Y, Q954H, N969K (EG.5.1);

T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, F456L, N460K, S477N, T478K, E484A, F486P, F490S, Q498R, N501Y, Y505H, D614G, H655Y, N679K, P681H, N764K, D796Y, Q954H, N969K (EG.5/FE.1/XBB.1.18.1.1);

T19I, L24del, P25del, P26del, A27S, V83A, G142D, Y144del, H146Q, K182N, Q183E, V213E, D253G, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, P521S, D614G, H655Y, N679K, P681H, N764K, D796Y, Q954H, N969K (XBB.2.3.3);

T19I, L24del, P25del, P26del, A27S, V83A, G142D, Y144del, H146Q, Q183E, V213E, D253G, G339H, R346T, L368I, S371F, S373P, S375F, T376A, D405N, R408S, K417N, N440K, V445P, G446S, N460K, S477N, T478Q, E484A, F486P, F490S, Q498R, N501Y, Y505H, P521S, D614G, H655Y, N679K, P681H, N764K, D796Y, Q954H, N969K (XBB.2.4);

T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, L518V, D614G, H655Y, N679K, P681H, N764K, D796Y, Q954H, N969K (GB.1);

T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, A701V, N764K, D796Y, Q954H, N969K (FL.1/FL.1.3);

T19I, L24del, P25del, P26del, A27S, G142D, K147N, M153T, N164K, V213G, H245N, G257D, G339D, G339H, R346T, S371F, S373P, S375F, T376A, D405N, R408S, K417N, N440K, K444R, G446S, N450D, L452M, N460K, S477N, T478K, E484R, F486S, Q498R, N501Y, Y505H, D614G, H655Y, N679K, P681H, N764K, D796Y, Q954H, N969K (FV.1);

T19I, L24del, P25del, P26del, A27S, V83A, G142D, E180V, Y144del, H146Q, Q183E, V213E, G252V, G339H, R346T, L368I, S371F, S373P, S375F, T376A, D405N, R408S, K417N, N440K, V445P, G446S, F456L, N460K, S477N, T478R, E484A, F486P, F490S, Q498R, N501Y, Y505H, D614G, H655Y, N679K, P681H, N764K, D796Y, Q954H, N969K (XBB.1.16.6);

T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, E554K, D614G, H655Y, N679K, P681H, N764K, D796Y, Q954H, N969K (XBB.1.19.1);

T19I, L24del, P25del, P26del, A27S, V83A, G142D, Y144del, H146Q, Q183E, Y200C, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, N764K, D796Y, Q954H, N969K (XBB.1.22.1);

T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, Q675H, N764K, D796Y, Q954H, N969K (EL.1);

L18F, T19R, R21G, T95I, G142D, W152L, E156G, F157del, R158del, F186L, V213G, D253G, G339D, R346T, S371F, S373P, S375F, T376A, D405N, R408S, K417N, N440K, G446D, S477N, L452R T478K, E484A, F486P, Q498R, N501Y, Y505H, D614G, P621S, H655Y, N679K, P681H, A706V N764K, D796Y, Q954H, N969K, D1153Y, T1117I (XAY-1.1.1);

T19I, L24del, P25del, P26del, A27S, V83A, G142D, Y144del, H146Q, Q183E, V213E, G252V, G339H, R346T, K356T, L368I, S371F, S373P, S375F, T376A, D405N, R408S, K417N, N440K, V445P, G446S, N460K, S477N, T478K, E484A, F486P, F490S, Q498R, N501Y, Y505H, T572I, D614G, H655Y, N679K, P681H, N764K, D796Y, Q954H, N969K (XBB.1.5.44).

It has to be emphasized that in the context embodiments of the invention any SARS-CoV-2 coronavirus spike protein as defined herein may be mutated as described above (exemplified for reference protein SEQ ID NO: 1) to stabilize the spike protein in the pre-fusion conformation.

According to various embodiments, the RNA of the invention encodes at least one antigenic SARS-CoV-2 spike protein as defined herein and, additionally, at least one heterologous peptide or protein element.

Suitably, the at least one heterologous peptide or protein element may promote or improve secretion of the encoded antigenic SARS-CoV-2 spike protein (e.g. via secretory signal sequences), promote or improve anchoring of the encoded antigenic SARS-CoV-2 spike protein in the plasma membrane (e.g. via transmembrane elements), promote or improve formation of antigen complexes (e.g. via multimerization domains or antigen clustering elements), or promote or improve virus-like particle formation (VLP forming sequence). In addition, the RNA of the first aspect may additionally encode peptide linker elements, self-cleaving peptides, immunologic adjuvant sequences or dendritic cell targeting sequences.

Suitable multimerization domains may be selected from the list of amino acid sequences according to SEQ ID NOs: 1116-1167 of WO2017/081082, or fragments or variants of these sequences. Suitable transmembrane elements may be selected from the list of amino acid sequences according to SEQ ID NOs: 1228-1343 of WO2017/081082, or fragments or variants of these sequences. Suitable VLP forming sequences may be selected from the list of amino acid sequences according to SEQ ID NOs: 1168-1227 of the patent application WO2017/081082, or fragments or variants of these sequences. Suitable peptide linkers may be selected from the list of amino acid sequences according to SEQ ID NOs: 1509-1565 of the patent application WO2017/081082, or fragments or variants of these sequences. Suitable self-cleaving peptides may be selected from the list of amino acid sequences according to SEQ ID NOs: 1434-1508 of the patent application WO2017/081082, or fragments or variants of these sequences. Suitable immunologic adjuvant sequences may be selected from the list of amino acid sequences according to SEQ ID NOs: 1360-1421 of the patent application WO2017/081082, or fragments or variants of these sequences. Suitable dendritic cell (DCs) targeting sequences may be selected from the list of amino acid sequences according to SEQ ID NOs: 1344-1359 of the patent application WO2017/081082, or fragments or variants of these sequences. Suitable secretory signal peptides may be selected from the list of amino acid sequences according to SEQ ID NOs: 1-1115 and SEQ ID NO: 1728 of published PCT patent application WO2017/081082, or fragments or variants of these sequences.

In preferred embodiments, the RNA encoding at least one antigenic SARS-CoV-2 spike protein additionally encodes at least one heterologous secretory signal sequences and/or trimerization element, and/or antigen clustering element, and/or VLP forming sequence.

Accordingly, in preferred embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 1-2, 45-67, 159-164, 183-201, 264-276 or an immunogenic fragment or immunogenic variant of any of these. Thus, in some embodiments, the SARS-CoV-2 spike protein is at least 95% identical to any one of SEQ ID NOs: 1-2, 45-67, 159-164 or 183-201, 264-276. In certain embodiments, the SARS-CoV-2 spike protein is identical to any one of SEQ ID NOs: 1-2, 45-67, 159-164 or 183-201, 264-276. Further information regarding said amino acid sequences is also provided in Table 1, and under <223> identifier of the ST26 sequence listing of respective sequence SEQ ID NOs.

Accordingly, in preferred embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 45-67, 159-164, 183-201, 264-276 or an immunogenic fragment or immunogenic variant of any of these. Thus, in some embodiments, the SARS-CoV-2 spike protein is at least 95%, identical to any one of SEQ ID NOs: 45-67 or 159-164 or 183-201, 264-276. In certain embodiments, the SARS-CoV-2 spike protein is identical to any one of SEQ ID NOs: 45-67 or 159-164 or 183-201, 264-276.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 45 or an immunogenic fragment or immunogenic variant of any of these. Thus, in some embodiments, the SARS-CoV-2 spike protein is at least 95%, identical to SEQ ID NO: 45. In certain embodiments, the SARS-CoV-2 spike protein is identical to SEQ ID NO: 45.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 46 or an immunogenic fragment or immunogenic variant of any of these. Thus, in some embodiments, the SARS-CoV-2 spike protein is at least 95%, identical to SEQ ID NO: 46. In certain embodiments, the SARS-CoV-2 spike protein is identical to SEQ ID NO: 46.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 47 or an immunogenic fragment or immunogenic variant of any of these. Thus, in some embodiments, the SARS-CoV-2 spike protein is at least 95%, identical to SEQ ID NO: 47. In certain embodiments, the SARS-CoV-2 spike protein is identical to SEQ ID NO: 47.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 48 or an immunogenic fragment or immunogenic variant of any of these. Thus, in some embodiments, the SARS-CoV-2 spike protein is at least 95%, identical to SEQ ID NO: 48. In certain embodiments, the SARS-CoV-2 spike protein is identical to SEQ ID NO: 48.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 49 or an immunogenic fragment or immunogenic variant of any of these. Thus, in some embodiments, the SARS-CoV-2 spike protein is at least 95%, identical to SEQ ID NO: 49. In certain embodiments, the SARS-CoV-2 spike protein is identical to SEQ ID NO: 49.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 50 or an immunogenic fragment or immunogenic variant of any of these. Thus, in some embodiments, the SARS-CoV-2 spike protein is at least 95%, identical to SEQ ID NO: 50. In certain embodiments, the SARS-CoV-2 spike protein is identical to SEQ ID NO: 50.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 51 or an immunogenic fragment or immunogenic variant of any of these. Thus, in some embodiments, the SARS-CoV-2 spike protein is at least 95%, identical to SEQ ID NO: 51. In certain embodiments, the SARS-CoV-2 spike protein is identical to SEQ ID NO: 51.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 52 or an immunogenic fragment or immunogenic variant of any of these. Thus, in some embodiments, the SARS-CoV-2 spike protein is at least 95%, identical to SEQ ID NO: 52. In certain embodiments, the SARS-CoV-2 spike protein is identical to SEQ ID NO: 52.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 53 or an immunogenic fragment or immunogenic variant of any of these. Thus, in some embodiments, the SARS-CoV-2 spike protein is at least 95%, identical to SEQ ID NO: 53. In certain embodiments, the SARS-CoV-2 spike protein is identical to SEQ ID NO: 53.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 54 or an immunogenic fragment or immunogenic variant of any of these. Thus, in some embodiments, the SARS-CoV-2 spike protein is at least 95%, identical to SEQ ID NO: 54. In certain embodiments, the SARS-CoV-2 spike protein is identical to SEQ ID NO: 54.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 55 or an immunogenic fragment or immunogenic variant of any of these. Thus, in some embodiments, the SARS-CoV-2 spike protein is at least 95%, identical to SEQ ID NO: 55. In certain embodiments, the SARS-CoV-2 spike protein is identical to SEQ ID NO: 55.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 159 or an immunogenic fragment or immunogenic variant of any of these. Thus, in some embodiments, the SARS-CoV-2 spike protein is at least 95%, identical to SEQ ID NO: 159. In certain embodiments, the SARS-CoV-2 spike protein is identical to SEQ ID NO: 159.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 160 or an immunogenic fragment or immunogenic variant of any of these. Thus, in some embodiments, the SARS-CoV-2 spike protein is at least 95%, identical to SEQ ID NO: 160. In certain embodiments, the SARS-CoV-2 spike protein is identical to SEQ ID NO: 160.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 161 or an immunogenic fragment or immunogenic variant of any of these. Thus, in some embodiments, the SARS-CoV-2 spike protein is at least 95%, identical to SEQ ID NO: 161. In certain embodiments, the SARS-CoV-2 spike protein is identical to SEQ ID NO: 161.

In preferred embodiments, the RNA of encodes at least one SARS-CoV-2 spike protein comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical SEQ ID NO: 162.

In preferred embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 162 or an immunogenic fragment or immunogenic variant of any of these. Thus, in some embodiments, the SARS-CoV-2 spike protein is at least 95%, identical to SEQ ID NO: 162. In certain embodiments, the SARS-CoV-2 spike protein is identical to SEQ ID NO: 162.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 163 or an immunogenic fragment or immunogenic variant of any of these. Thus, in some embodiments, the SARS-CoV-2 spike protein is at least 95%, identical to SEQ ID NO: 163. In certain embodiments, the SARS-CoV-2 spike protein is identical to SEQ ID NO: 163.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 164 or an immunogenic fragment or immunogenic variant of any of these. Thus, in some embodiments, the SARS-CoV-2 spike protein is at least 95%, identical to SEQ ID NO: 164. In certain embodiments, the SARS-CoV-2 spike protein is identical to SEQ ID NO: 164.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 183 or an immunogenic fragment or immunogenic variant of any of these. Thus, in some embodiments, the SARS-CoV-2 spike protein is at least 95%, identical to SEQ ID NO: 183. In certain embodiments, the SARS-CoV-2 spike protein is identical to SEQ ID NO: 183.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 184 or an immunogenic fragment or immunogenic variant of any of these. Thus, in some embodiments, the SARS-CoV-2 spike protein is at least 95%, identical to SEQ ID NO: 184. In certain embodiments, the SARS-CoV-2 spike protein is identical to SEQ ID NO: 184.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 185 or an immunogenic fragment or immunogenic variant of any of these. Thus, in some embodiments, the SARS-CoV-2 spike protein is at least 95%, identical to SEQ ID NO: 185. In certain embodiments, the SARS-CoV-2 spike protein is identical to SEQ ID NO: 185.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 186 or an immunogenic fragment or immunogenic variant of any of these. Thus, in some embodiments, the SARS-CoV-2 spike protein is at least 95%, identical to SEQ ID NO: 186. In certain embodiments, the SARS-CoV-2 spike protein is identical to SEQ ID NO: 186.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 187 or an immunogenic fragment or immunogenic variant of any of these. Thus, in some embodiments, the SARS-CoV-2 spike protein is at least 95%, identical to SEQ ID NO: 187. In certain embodiments, the SARS-CoV-2 spike protein is identical to SEQ ID NO: 187.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 188 or an immunogenic fragment or immunogenic variant of any of these. Thus, in some embodiments, the SARS-CoV-2 spike protein is at least 95%, identical to SEQ ID NO: 188. In certain embodiments, the SARS-CoV-2 spike protein is identical to SEQ ID NO: 188.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 189 or an immunogenic fragment or immunogenic variant of any of these. Thus, in some embodiments, the SARS-CoV-2 spike protein is at least 95%, identical to SEQ ID NO: 189. In certain embodiments, the SARS-CoV-2 spike protein is identical to SEQ ID NO: 189.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 190 or an immunogenic fragment or immunogenic variant of any of these. Thus, in some embodiments, the SARS-CoV-2 spike protein is at least 95%, identical to SEQ ID NO: 190. In certain embodiments, the SARS-CoV-2 spike protein is identical to SEQ ID NO: 190.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 191 or an immunogenic fragment or immunogenic variant of any of these. Thus, in some embodiments, the SARS-CoV-2 spike protein is at least 95%, identical to SEQ ID NO: 191. In certain embodiments, the SARS-CoV-2 spike protein is identical to SEQ ID NO: 191.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 192 or an immunogenic fragment or immunogenic variant of any of these. Thus, in some embodiments, the SARS-CoV-2 spike protein is at least 95%, identical to SEQ ID NO: 192. In certain embodiments, the SARS-CoV-2 spike protein is identical to SEQ ID NO: 192.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 193 or an immunogenic fragment or immunogenic variant of any of these. Thus, in some embodiments, the SARS-CoV-2 spike protein is at least 95%, identical to SEQ ID NO: 193. In certain embodiments, the SARS-CoV-2 spike protein is identical to SEQ ID NO: 193.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 194 or an immunogenic fragment or immunogenic variant of any of these. Thus, in some embodiments, the SARS-CoV-2 spike protein is at least 95%, identical to SEQ ID NO: 194. In certain embodiments, the SARS-CoV-2 spike protein is identical to SEQ ID NO: 194.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 195 or an immunogenic fragment or immunogenic variant of any of these. Thus, in some embodiments, the SARS-CoV-2 spike protein is at least 95%, identical to SEQ ID NO: 195. In certain embodiments, the SARS-CoV-2 spike protein is identical to SEQ ID NO: 195.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 196 or an immunogenic fragment or immunogenic variant of any of these. Thus, in some embodiments, the SARS-CoV-2 spike protein is at least 95%, identical to SEQ ID NO: 196. In certain embodiments, the SARS-CoV-2 spike protein is identical to SEQ ID NO: 196.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 197 or an immunogenic fragment or immunogenic variant of any of these. Thus, in some embodiments, the SARS-CoV-2 spike protein is at least 95%, identical to SEQ ID NO: 197. In certain embodiments, the SARS-CoV-2 spike protein is identical to SEQ ID NO: 197.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 198 or an immunogenic fragment or immunogenic variant of any of these. Thus, in some embodiments, the SARS-CoV-2 spike protein is at least 95%, identical to SEQ ID NO: 198. In certain embodiments, the SARS-CoV-2 spike protein is identical to SEQ ID NO: 198.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 199 or an immunogenic fragment or immunogenic variant of any of these. Thus, in some embodiments, the SARS-CoV-2 spike protein is at least 95%, identical to SEQ ID NO: 199. In certain embodiments, the SARS-CoV-2 spike protein is identical to SEQ ID NO: 199.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 200 or an immunogenic fragment or immunogenic variant of any of these. Thus, in some embodiments, the SARS-CoV-2 spike protein is at least 95%, identical to SEQ ID NO: 200. In certain embodiments, the SARS-CoV-2 spike protein is identical to SEQ ID NO: 200.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 201 or an immunogenic fragment or immunogenic variant of any of these. Thus, in some embodiments, the SARS-CoV-2 spike protein is at least 95%, identical to SEQ ID NO: 201. In certain embodiments, the SARS-CoV-2 spike protein is identical to SEQ ID NO: 201.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 264 or an immunogenic fragment or immunogenic variant of any of these. Thus, in some embodiments, the SARS-CoV-2 spike protein is at least 95%, identical to SEQ ID NO: 264. In certain embodiments, the SARS-CoV-2 spike protein is identical to SEQ ID NO: 264.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 265 or an immunogenic fragment or immunogenic variant of any of these. Thus, in some embodiments, the SARS-CoV-2 spike protein is at least 95%, identical to SEQ ID NO: 265. In certain embodiments, the SARS-CoV-2 spike protein is identical to SEQ ID NO: 265.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 266 or an immunogenic fragment or immunogenic variant of any of these. Thus, in some embodiments, the SARS-CoV-2 spike protein is at least 95%, identical to SEQ ID NO: 266. In certain embodiments, the SARS-CoV-2 spike protein is identical to SEQ ID NO: 266.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 267 or an immunogenic fragment or immunogenic variant of any of these. Thus, in some embodiments, the SARS-CoV-2 spike protein is at least 95%, identical to SEQ ID NO: 267. In certain embodiments, the SARS-CoV-2 spike protein is identical to SEQ ID NO: 267.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 268 or an immunogenic fragment or immunogenic variant of any of these. Thus, in some embodiments, the SARS-CoV-2 spike protein is at least 95%, identical to SEQ ID NO: 268. In certain embodiments, the SARS-CoV-2 spike protein is identical to SEQ ID NO: 268.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 269 or an immunogenic fragment or immunogenic variant of any of these. Thus, in some embodiments, the SARS-CoV-2 spike protein is at least 95%, identical to SEQ ID NO: 269. In certain embodiments, the SARS-CoV-2 spike protein is identical to SEQ ID NO: 269.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 270 or an immunogenic fragment or immunogenic variant of any of these. Thus, in some embodiments, the SARS-CoV-2 spike protein is at least 95%, identical to SEQ ID NO: 270. In certain embodiments, the SARS-CoV-2 spike protein is identical to SEQ ID NO: 270.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 271 or an immunogenic fragment or immunogenic variant of any of these. Thus, in some embodiments, the SARS-CoV-2 spike protein is at least 95%, identical to SEQ ID NO: 271. In certain embodiments, the SARS-CoV-2 spike protein is identical to SEQ ID NO: 271.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 272 or an immunogenic fragment or immunogenic variant of any of these. Thus, in some embodiments, the SARS-CoV-2 spike protein is at least 95%, identical to SEQ ID NO: 272. In certain embodiments, the SARS-CoV-2 spike protein is identical to SEQ ID NO: 272.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 273 or an immunogenic fragment or immunogenic variant of any of these. Thus, in some embodiments, the SARS-CoV-2 spike protein is at least 95%, identical to SEQ ID NO: 273. In certain embodiments, the SARS-CoV-2 spike protein is identical to SEQ ID NO: 273.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 274 or an immunogenic fragment or immunogenic variant of any of these. Thus, in some embodiments, the SARS-CoV-2 spike protein is at least 95%, identical to SEQ ID NO: 274. In certain embodiments, the SARS-CoV-2 spike protein is identical to SEQ ID NO: 274.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 275 or an immunogenic fragment or immunogenic variant of any of these. Thus, in some embodiments, the SARS-CoV-2 spike protein is at least 95%, identical to SEQ ID NO: 275. In certain embodiments, the SARS-CoV-2 spike protein is identical to SEQ ID NO: 275.

In further embodiments, the SARS-CoV-2 spike protein that is encoded by the RNA of the invention comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 276 or an immunogenic fragment or immunogenic variant of any of these. Thus, in some embodiments, the SARS-CoV-2 spike protein is at least 95%, identical to SEQ ID NO: 276. In certain embodiments, the SARS-CoV-2 spike protein is identical to SEQ ID NO: 276.

Antigenic peptide or proteins derived from a SARS-CoV-2 as defined herein are provided in Table 1. Therein, each row corresponds to a suitable SARS-CoV-2 spike protein construct. Column A of Table 1 provides a short description of the suitable antigen constructs. Column B of Table 1 provides protein (amino acid) SEQ ID NOs of respective antigen constructs. Column C Table 1 provides SEQ ID NO of the corresponding G/C optimized nucleic acid coding sequences (for a detailed description of "coding sequences", see paragraph "suitable coding sequences").

Notably, the description of the invention explicitly includes the information provided in the ST26 sequence listing of the present application. Preferred RNA constructs comprising coding sequences of Table 1, e.g. mRNA sequences comprising the coding sequences of Table 1, are provided in Table 2.

TABLE 1

Preferred SARS-COV-2 constructs (amino acid sequences and nucleic acid coding sequences):

| row | A | B | C |
|---|---|---|---|
| 1 | S_stab_PP(K986P_V987P_T19I_24del_P25del_P26del_A27S_V83A_G142D_Y144del_H146Q_Q183E_V213E_G252V_G339H_R346T_L368I_S371F_S373P_S375F_T376A_D405N_R408S_K417N_N440K_V445P_G446S_N460K_S477N_T478K_E484A_F486S_F490S_Q498R_N501Y_Y505H_D614G_H655Y_N679K_P681H_N764K_D796Y_Q954H_N969K); XBB.1 | 45 | 70 |
| 2 | S_stab_PP_(K986P_V987P_T19I_24del_P25del_P26del_A27S_V83A_G142D_Y144del_H146Q_Q183E_V213E_G339H_R346T_L368I_S371F_S373P_S375F_T376A_D405N_R408S_K417N_N440K_V445P_G446S_S477N_T478K_V483A_E484A_F490V_Q493R_Q498R_N501Y_Y505H_D614G_H655Y_N679K_P681H_N764K_D796Y_G798D_Q954H_N969K_S1003I); BJ.1 | 46 | 71 |
| 3 | S_stab_PP(K986P_V987P_T19I_L24del_P25del_P26del_A27S_H69del_V70del_G142D_V213G_G339D_R346T_S371F_S373P_S375F_T376A_D405N_R408S_K417N_N440K_K444T_L452R_N460K_S477N_T478K_E484A_F486V_Q498R_N501Y_Y505H_D614G_H655Y_N679K_P681H_N764K_D796Y_Q954H_N969K); BQ.1.1 | 47 | 72 |
| 4 | S_stab_PP(K986P_V987P_T19I_L24del_P25del_P26del_A27S_H69del_V70del_G142D_Y144del_V213G_G339D_S371F_S373P_S375F_T376A_D405N_R408S_K417N_N440K_K444M_452R_N460K_S477N_T478K_E484A_F486V_Q498R_N501Y_Y505H_D614G_H655Y_N679K_P681H_N764K_D796Y_Q954H_N969K); BU.1 | 48 | 73 |
| 5 | S_stab_PP(K986P_V987P_T19I_L24del_P25del_P26del_A27S_H69del_V70del_G142D_V213G_G339D_S371F_S373P_S375F_T376A_D405N_R408S_K417N_N440K_L452R_S477N_T478K_E484A_F486V_Q498R_N501Y_Y505H_D614G_H655Y_N679K_P681H_N764K_D796Y_Q954H_N969K_A1020S); BF.5 | 49 | 74 |
| 6 | S_stab_PP(K986P_V987P_T19I_L24del_P25del_P26del_A27S_G142D_K147E_W152R_F157L_I210V_V213G_G257S_G339H_S371F_S373P_S375F_T376A_D405N_R408S_K417N_N440K_G446S_N460K_S477N_T478K_E484A_Q498R_N501Y_Y505H_D614G_H655Y_N679K_P681H_N764K_D796Y_Q954H_N969K); BA.2.75 | 50 | 75 |
| 7 | S_stab_PP(K986P_V987P_T19I_24del_P25del_P26del_A27S_G142D_K147E_W152R_F157L_I210V_V213G_G257S_G339H_S371F_S373P_S375F_T376A_D405N_R408S_K417N_N440K_G446S_N460K_S477N_T478K_E484A_Q498R_N501Y_Y505H_D574V_D614G_H655Y_N679K_P681H_N764K_D796Y_Q954H_N969K); BA.2.75.1 | 51 | 76 |
| 8 | S_stab_PP(K986P_V987P_T19I_L24del_P25del_P26del_A27S_G142D_K147E_W152R_F157L_I210V_V213G_G257S_G339H_R346T_S371F_S373P_S375F_T376A_D405N_R408S_K417N_N440K_G446S_N460K_S477N_T478K_E484A_F486S_Q498R_N501Y_Y505H_D614G_H655Y_N679K_P681H_N764K_D796Y_Q954H_N969K_D1199N); BA.2.75.2 | 52 | 77 |
| 9 | S_stab_PP(K986P_V987P_T19I_24del_P25del_P26del_A27S_G142D_K147E_W152R_F157L_I210V_V213G_G257S_G339H_R346T_S371F_S373P_S375F_T376A_D405N_R408S_K417N_N440K_G446S_L452R_N460K_S477N_T478K_E484A_F486S_Q498R_N501Y_Y505H_T604I_D614G_H655Y_N679K_P681H_N764K_D796Y_Q954H_N969K_D1199N); CA.1 | 53 | 78 |
| 10 | S_stab_PP(K986P_V987P_T19I_24del_P25del_P26del_A27S_G142D_K147E_W152R_F157L_I210V_V213G_G257S_G339H_R346T_S371F_S373P_S375F_T376A_D405N_R408S_K417N_N440K_G446S_N460K_S477N_T478K_E484A_F486S_Q498R_N501Y_Y505H_D614G_H655Y_N679K_P681H_N764K_D796Y_Q954H_N969K); BM1.1 | 54 | 79 |

TABLE 1-continued

Preferred SARS-COV-2 constructs (amino acid sequences and nucleic acid coding sequences):

| row | A | B | C |
|---|---|---|---|
| 11 | S_stab_PP(K986P_V987P_T19I_L24del_P25del_P26del_A27S_G142D_K147E_W152R_F157L_I210V_V213G_G257S_G339H_R346T_S371F_S373P_S375F_T376A_D405N_R408S_K417N_N440K_G446S_N460K_S477N_T478K_E484A_F486S_F490S_Q498R_N501Y_Y505H_D614G_H655Y_N679K_P681H_N764K_D796Y_Q954H_N969K); BM.1.1.1 | 55 | 80 |
| 12 | S_stab_PP(K986P_V987P_K444T_N460K) | | |
| 13 | S_stab_PP(K986P_V987P_K444M_N460K) | | |
| 14 | S_stab_PP(K986P_V987P_V83A_H146Q_Q183E_V213E_G252V_G339H_L368I_V445P_N460K_F486S) | | |
| 15 | S_stab_PP(K986P_V987P_N460K_F490S) | | |
| 16 | S_stab_PP(K986P_V987P_R346T_N460K_F490S) | | |
| 17 | S_stab_PP(K986P_V987P_Y144del_R346T_N460K_F490S) | | |
| 18 | S_stab_PP(K986P_V987P_N460K) | | |
| 19 | S_stab_PP(K986P_V987P_L452R_N460K) | | |
| 20 | S_stab_PP(K986P_V987P_R346T_K444T_N460K) | | |
| 21 | S_stab_PP(K986P_V987P_Y144del_K444M_N460K) | | |
| 22 | S_stab_PP(K986P_V987P_Y144del_G252V_N460K) | | |
| 23 | S_stab_PP(K986P_V987P_G339H_R346T) | | |
| 24 | S_stab_PP(K986P_V987P_R346T_F486S) | | |
| 25 | S_stab_PP(K986P_V987P_R346T_F486S_D1199N) | | |
| 26 | S_stab_PP(K986P_V987P_R346T_N658S) | | |
| 27 | S_stab_PP(K986P_V987P_L452R_T604I) | | |
| 28 | S_stab_PP(K986P_V987P_K444M_A1020S) | | |
| 29 | S_stab_PP(K986P_V987P_V83A_H146Q_Q183E_V213E_G252V_G339H_L368I_V445P_N460K_F486S_F490S) | | |
| 30 | S_stab_PP(K986P_V987P_V83A) | | |
| 31 | S_stab_PP(K986P_V987P_H146Q) | | |
| 32 | S_stab_PP(K986P_V987P_K147E) | | |
| 33 | S_stab_PP(K986P_V987P_Q183E) | | |
| 34 | S_stab_PP(K986P_V987P_I210V) | | |
| 35 | S_stab_PP(K986P_V987P_V213E) | | |
| 36 | S_stab_PP(K986P_V987P_G252V) | | |
| 37 | S_stab_PP(K986P_V987P_G257S) | | |
| 38 | S_stab_PP(K986P_V987P_G339H) | | |
| 39 | S_stab_PP(K986P_V987P_L368I) | | |
| 40 | S_stab_PP(K986P_V987P_K444M) | | |
| 41 | S_stab_PP(K986P_V987P_K444T) | | |
| 42 | S_stab_PP(K986P_V987P_V445P) | | |
| 43 | S_stab_PP(K986P_V987P_F486S) | | |
| 44 | S_stab_PP(K986P_V987P_F490V) | | |
| 45 | S_stab_PP(K986P_V987P_D574V) | | |
| 46 | S_stab_PP(K986P_V987P_T604I) | | |
| 47 | S_stab_PP(K986P_V987P_N658S) | | |
| 48 | S_stab_PP(K986P_V987P_G798D) | | |
| 49 | S_stab_PP(K986P_V987P_S1003I) | | |
| 50 | S_stab_PP(K986P_V987P_A1020S) | | |
| 51 | S_stab_PP(K986P_V987P_D1199N) | | |
| 52 | S_stab_PP(K986P_V987P_K444T_N460K_D614G) | | |
| 53 | S_stab_PP(K986P_V987P_K444M_N460K_D614G) | | |
| 54 | S_stab_PP(K986P_V987P_V83A_H146Q_Q183E_V213E_G252V_G339H_L368I_V445P_N460K_F486S_D614G) | | |
| 55 | S_stab_PP(K986P_V987P_N460K_F490S_D614G) | | |
| 56 | S_stab_PP(K986P_V987P_R346T_N460K_F490S_D614G) | | |
| 57 | S_stab_PP(K986P_V987P_Y144del_R346T_N460K_F490S_D614G) | | |
| 58 | S_stab_PP(K986P_V987P_N460K_D614G) | | |
| 59 | S_stab_PP(K986P_V987P_L452R_N460K_D614G) | | |
| 60 | S_stab_PP(K986P_V987P_R346T_K444T_N460K_D614G) | | |
| 61 | S_stab_PP(K986P_V987P_Y144del_K444M_N460K_D614G) | | |
| 62 | S_stab_PP(K986P_V987P_Y144del_G252V_N460K_D614G) | | |
| 63 | S_stab_PP(K986P_V987P_G339H_R346T_D614G) | | |
| 64 | S_stab_PP(K986P_V987P_R346T_F486S_D614G) | | |
| 65 | S_stab_PP(K986P_V987P_R346T_F486S_D614G_D1199N) | | |
| 66 | S_stab_PP(K986P_V987P_R346T_D614G_N658S) | | |
| 67 | S_stab_PP(K986P_V987P_L452R_T604I_D614G) | | |
| 68 | S_stab_PP(K986P_V987P_K444M_D614G_A1020S) | | |
| 69 | S_stab_PP(K986P_V987P_V83A_H146Q_Q183E_V213E_G252V_G339H_L368I_V445P_N460K_F486S_F490S_D614G) | | |
| 70 | S_stab_PP(K986P_V987P_V83A_D614G) | | |
| 71 | S_stab_PP(K986P_V987P_H146Q_D614G) | | |
| 72 | S_stab_PP(K986P_V987P_K147E_D614G) | | |
| 73 | S_stab_PP(K986P_V987P_Q183E_D614G) | | |
| 74 | S_stab_PP(K986P_V987P_I210V_D614G) | | |
| 75 | S_stab_PP(K986P_V987P_V213E_D614G) | | |
| 76 | S_stab_PP(K986P_V987P_G252V_D614G) | | |
| 77 | S_stab_PP(K986P_V987P_G257S_D614G) | | |
| 78 | S_stab_PP(K986P_V987P_G339H_D614G) | | |
| 79 | S_stab_PP(K986P_V987P_L368I_D614G) | | |

TABLE 1-continued

Preferred SARS-COV-2 constructs (amino acid sequences and nucleic acid coding sequences):

| row | A | B | C |
|---|---|---|---|
| 80 | S_stab_PP(K986P_V987P_K444M_D614G) | | |
| 81 | S_stab_PP(K986P_V987P_K444T_D614G) | | |
| 82 | S_stab_PP(K986P_V987P_V445P_D614G) | | |
| 83 | S_stab_PP(K986P_V987P_F486S_D614G) | | |
| 84 | S_stab_PP(K986P_V987P_F490V_D614G) | | |
| 85 | S_stab_PP(K986P_V987P_D574V_D614G) | | |
| 86 | S_stab_PP(K986P_V987P_T604I_D614G) | | |
| 87 | S_stab_PP(K986P_V987P_N658S_D614G) | | |
| 88 | S_stab_PP(K986P_V987P_G798D_D614G) | | |
| 89 | S_stab_PP(K986P_V987P_S1003I_D614G) | | |
| 90 | S_stab_PP(K986P_V987P_A1020S_D614G) | | |
| 91 | S_stab_PP(K986P_V987P_D1199N_D614G) | | |
| 92 | S_stab_PP(K986P_V987P_T19I_L24del_P25del_P26del_A27S_G142D_K147E_W152R_ F157L_I210V_V213G_G257S_G339H_R346T_K356T_S371F_S373P_S375F_T376A_D405N_ R408S_K417N_N440K_G446S_N460K_S477N_T478K_E484A_F490S_Q498R_N501Y_Y505H_ D614G_H655Y_N679K_P681H_N764K_D796Y_Q954H_N969K); BN.1 | 159 | 165 |
| 93 | S_stab_PP(K986P_V987P_T19I_L24del_P25del_P26del_A27S_G142D_K147E_W152R_ F157L_I210V_V213G_G257S_G339H_R346T_S371F_S373P_S375F_T376A_D405N_R408S_ K417N_N440K_G446S_N460K_S477N_T478K_E484A_F486P_F490S_Q498R_N501Y_Y505H_ D614G_H655Y_N679K_P681H_N764K_D796Y_Q954H_N969K); XBF | 160 | 166 |
| 94 | S_stab_PP(K986P_V987P_T19I_L24del_P25del_P26del_A27S_G142D_M153T_N164K_ V213G_H245N_G257D_G339N_S371F_S373P_S375F_T376A_D405N_R408S_K417N_N440K_ K444R_N450D_L452M_N460K_S477N_T478K_E484A_Q498R_N501Y_Y505H_D614G_H655Y_ N679K_P681H_N764K_D796Y_Q954H_N969K); CM.2 | 161 | 167 |
| 95 | S_stab_PP(K986P_V987P_T19I_L24del_P25del_P26del_A27S_V83A_G142D_Y144del_ H146Q_Q183E_V213E_G252V_G339H_R346T_L368I_S371F_S373P_S375F_T376A_D405N_ R408S_K417N_N440K_V445P_G446S_N460K_S477N_T478K_E484A_F486P_F490S_Q498R_ N501Y_Y505H_D614G_H655Y_N679K_P681H_N764K_D796Y_Q954H_N969K); XBB.1.5 | 162 | 168 |
| 96 | S_stab_PP(K986P_V987P_T19I_P25S_G142D_Y144del_E156G_F157del_R158del_P209L_ L212S_D215H_A222V_A243del_L244del_S371F_S373P_S375F_T376A_D405N_R408S_ K417N_N440K_G446S_L452M_S477N_T478K_E484A_F486P_Q498R_N501Y_Y505H_D614G_ H655Y_N679K_P681H_N703I_N764K_D796Y_Q954H_N969K); XBC.1 | 163 | 169 |
| 97 | S_stab_PP(K986P_V987P_T19I_P25S_K97R_G142D_Y144del_E156G_F157del_R158del_ P209L_L212S_D215H_A222V_A243del_L244del_S371F_S373P_S375F_T376A_D405N_ R408S_K417N_N440K_G446S_S477N_T478K_E484A_F486P_Q498R_N501Y_Y505H_D614G_ _H655Y_N679K_P681H_N703I_N764K_D796Y_Q954H_N969K); XBC.2 | 164 | 170 |
| 98 | S_stab_PP(K986P_V987P_T19I_L24del_P25del_P26del_A27S_H69del_V70del_G142D_ V213G_G339D_S371F_S373P_S375F_T376A_D405N_R408S_K417N_N440K_K444T_L452R_ N460K_S477N_T478K_E484A_F486V_Q498R_N501Y_Y505H_D614G_H655Y_I666V_N679K_ P681H_N764K_D796Y_Q954H_N969K); BQ.1.2 | | |
| 99 | S_stab_PP(K986P_V987P_F486P) | | |
| 100 | S_stab_PP(K986P_V987P_F486P_N460K) | | |
| 101 | S_stab_PP(K986P_V987P_R346T_F486P_N460K) | | |
| 102 | S_stab_PP(K986P_V987P_Y144del_F486P_N460K) | | |
| 103 | S_stab_PP(K986P_V987P_F490S_F486P_N460K) | | |
| 104 | S_stab_PP(K986P_V987P_F486P_D614G) | | |
| 105 | S_stab_PP(K986P_V987P_T19I_L24del_P25del_P26del_A27S_H69del_V70del_G142D_ Y144del_V213G_G339D_R346T_S371F_S373P_S375F_T376A_D405N_R408S_K417N_N440K_ K444T_L452R_N460K_S477N_T478K_E484A_F486V_Q498R_N501Y_Y505H_D614G_H655Y_ N679K_P681H_N764K_D796Y_Q954H_N969K); BQ.1.18 | 183 | 202 |
| 106 | S_stab_PP(K986P_V987P_T19I_L24del_P25del_P26del_A27S_V83A_G142D_E180V_ Y144del_H146Q_Q183E_V213E_G252V_G339H_R346T_L368I_S371F_S373P_S375F_T376A_ D405N_R408S_K417N_N440K_V445P_G446S_N460K_S477N_T478R_E484A_F486P_F490S_ Q498R_N501Y_Y505H_D614G_H655Y_N679K_P681H_N764K_D796Y_Q954H_N969K); XBB.1.16 | 184 | 203 |
| 107 | S_stab_PP(K986P_V987P_T19I_24del_P25del_P26del_A27S_V83A_G142D_E180V_ Y144del_H146Q_Q183E_V213E_G252V_G339H_R346T_L368I_S371F_S373P_S375F_T376A_ D405N_R408S_K417N_N440K_V445P_G446S_N460K_S477N_T478R_E484A_F486P_F490S_ Q498R_N501Y_Y505H_T547I_D614G_H655Y_N679K_P681H_N764K_D796Y_Q954H_N969K); XBB.1.16.1 | 185 | 204 |
| 108 | S_stab_PP(K986P_V987P_T19I_24del_P25del_P26del_A27S_V83A_G142D_Y144del_ H146Q_Q183E_D215H_V213E_G252V_G339H_R346T_L368I_S371F_S373P_S375F_T376A_ D405N_R408S_K417N_N440K_V445P_G446S_N460K_S477N_T478K_E484A_F486P_F490S_ Q498R_N501Y_Y505H_D614G_H655Y_N679K_P681H_N764K_D796Y_Q954H_N969K); XBB.1.17.1 | 186 | 205 |
| 109 | S_stab_PP(K986P_V987P_T19I_24del_P25del_P26del_A27S_V83A_G142D_Y144del_ H146Q_Q183E_V213E_G339H_R346T_L368I_S371F_S373P_S375F_T376A_D405N_R408S_ K417N_N440K_V445P_G446S_N460K_S477N_T478K_E484A_F486P_F490S_Q498R_N501Y_ Y505H_D614G_H655Y_N679K_P681H_N764K_D796Y_Q954H_N969K); XBB.1.22 | 187 | 206 |
| 110 | S_stab_PP(K986P_V987P_T19I_24del_P25del_P26del_A27S_V83A_G142D_Y144del_ H146Q_Q183E_V213E_D253G_G339H_R346T_L368I_S371F_S373P_S375F_T376A_D405N_ R408S_K417N_N440K_V445P_G446S_N460K_S477N_T478K_E484A_F486P_F490S_Q498R_ N501Y_Y505H_P521S_D614G_H655Y_N679K_P681H_N764K_D796Y_Q954H_N969K); XBB.2.3 | 188 | 207 |
| 111 | S_stab_PP(K986P_V987P_T19I_L24del_P25del_P26del_A27S_D80Y_V83A_G142D_ Y144del_H146Q_Q183E_V213E_D253G_G339H_R346T_L368I_S371F_S373P_S375F_ | 189 | 208 |

TABLE 1-continued

Preferred SARS-COV-2 constructs (amino acid sequences and nucleic acid coding sequences):

| row | A | B | C |
|---|---|---|---|
|  | T376A_D405N_R408S_K417N_N440K_V445P_G446S_N460K_S477N_T478K_E484A_F486P_ F490S_Q498R_N501Y_Y505H_P521S_D614G_H655Y_N679K_P681H_N764K_D796Y_Q954H_ N969K); XBB.2.3.1 | | |
| 112 | S_stab_PP(K986P_V987P_T19I_L24del_P25del_P26del_A27S_V83A_G142D_Y144del_ H146Q_Q183E_G184V_V213E_D253G_G339H_R346T_L368I_S371F_S373P_S375F_T376A_ D405N_R408S_K417N_N440K_V445P_G446S_N460K_S477N_T478K_E484A_F486P_F490S_ Q498R_N501Y_Y505H_P521S_D614G_H655Y_N679K_P681H_N764K_D796Y_Q954H_N969K); XBB.2.3.2 | 190 | 209 |
| 113 | S_stab_PP(K986P_V987P_L18F_T19R_R21G_T95I_W152L_E156G_F157del_R158del_ F186L_V213G_G339D_S371F_S373P_S375F_T376A_D405N_R408S_K417N_N440K_G446D_ S477N_L452R_T478K_E484A_F486P_Q498R_N501Y_Y505H_D614G_P621S_H655Y_N679K_ P681H_A706V_N764K_D796Y_Q954H_N969K_T1117I); XAY.2 | 191 | 210 |
| 114 | S_stab_PP(K986P_V987P_T19I_L24del_P25del_P26del_A27S_V83A_G142D_Y144del_ H146K_Q183E_V213E_G252V_G339H_R346T_L368I_S371F_S373P_S375F_T376A_D405N_ R408S_K417N_N440K_V445P_G446S_N460K_S477N_T478K_E484A_F486P_F490S_Q498R_ N501Y_Y505H_D614G_H655Y_N679K_P681H_N764K_D796Y_Q954H_N969K); FD.2 | 192 | 211 |
| 115 | S_stab_PP(K986P_V987P_T19I_L24del_P25del_P26del_A27S_H69del_V70del_ G142D_V213G_G339D_R346T_S371F_S373P_S375F_T376A_D405N_R408S_K417N_N440K_ L452R_S477N_T478K_E484A_F486V_Q498R_N501Y_Y505H_D614G_H655Y_N679K_P681H_ N764K_D796Y_Q954H_N969K); BF.7 | 193 | 212 |
| 116 | S_stab_PP(K986P_V987P_T19I_L24del_P25del_P26del_A27S_H69del_V70del_G142D_ V213G_R346T_G339D_S371F_S373P_S375F_T376A_D405N_R408S_K417N_N440K_L452R_ S477N_T478K_E484A_F486V_Q498R_N501Y_Y505H_D614G_H655Y_N679K_P681H_N764K_ D796Y_Q954H_N969K_C1243F); BF.7.14 | 194 | 213 |
| 117 | S_stab_PP(K986P_V987P_T19I_L24del_P25del_P26del_A27S_G142D_K147E_W152R_ F157L_I210V_V213G_G257S_G339H_R346T_S371F_S373P_S375F_T376A_D405N_R408S_ K417N_N440K_K444T_G446S_N460K_L452R_S477N_T478K_E484A_F486P_Q498R_N501Y_ Y505H_D614G_H655Y_N679K_P681H_N764K_D796Y_Q954H_N969K); CH.1.1 | 195 | 214 |
| 118 | S_stab_PP(K986P_V987P_T19I_L24del_P25del_P26del_A27S_G142D_K147E_W152R_ F157L_N185D_I210V_V213G_G257S_G339H_R346T_S371F_S373P_S375F_T376A_D405N_ R408S_K417N_N440K_K444T_G446S_N460K_L452R_S477N_T478K_E484A_F486S_Q493R_ Q498R_N501Y_Y505H_D614G_H655Y_N679K_P681H_N764K_D796Y_Q954H_N969K); CH.1.1.1 | 196 | 215 |
| 119 | S_stab_PP(K986P_V987P_T19I_L24del_P25del_P26del_A27S_G142D_K147E_W152R_ F157L_I210V_V213G_G257S_G339H_R346T_S371F_S373P_S375F_T376A_D405N_R408S_ K417N_N440K_K444T_G446S_N460K_L452R_S477N_T478K_E484A_F486S_Q493R_Q498R_ N501Y_Y505H_D614G_H655Y_N679K_P681H_N764K_D796Y_T883I_Q954H_N969K); CH.1.1.2 | 197 | 216 |
| 120 | S_stab_PP(K986P_V987P_T19I_L24del_P25del_P26del_A27S_H69del_V70del_ G142D_Y144del_V213G_D253G_G339D_R346T_S371F_S373P_S375F_T376A_D405N_ R408S_K417N_N440K_K444T_L452R_N460K_S477N_T478K_E484A_F486V_Q498R_ N501Y_Y505H_D614G_H655Y_N679K_P681H_N764K_D796Y_Q954H_N969K); DU.1 | 198 | 217 |
| 121 | S_stab_PP(K986P_V987P_T19I_L24del_P25del_P26del_A27S_V83A_G142D_Y144del_ H146Q_Q183E_V213E_G252V_G339H_R346T_L368I_S371F_S373P_S375F_T376A_D405N_ R408S_K417N_N440K_V445P_G446S_N460K_S477N_T478K_E484A_F486P_F490S_Q498R_ N501Y_Y505H_Q613H_D614G_H655Y_N679K_P681H_N764K_D796Y_Q954H_N969K); EG.1 | 199 | 218 |
| 122 | S_stab_PP(K986P_V987P_T19I_P25S_G142D_Y144del_E156G_F157del_R158del_ P209L_L212S_D215H_A222V_A243del_L244del_S256L_R346S_S371F_S373P_S375F_ T376A_D405N_R408S_K417N_N440K_G446S_L452R_S477N_T478K_E484A_F486P_Q498R_ N501Y_Y505H_D614G_H655Y_N679K_P681H_N703I_N764K_D796Y_Q954H_N969K); XBC.1.6 | 200 | 219 |
| 123 | S_stab_PP(K986P_V987P_T19I_L24del_P25del_P26del_A27S_V83A_G142D_Y144del_ H146Q_Q183E_V213E_G252V_G339H_R346T_L368I_S371F_S373P_S375F_T376A_D405N_ R408S_I410V_K417N_N440K_V445P_G446S_N460K_S477N_T478K_E484A_F486P_F490S_ Q498R_N501Y_Y505H_P521S_D614G_H655Y_N679K_P681H_N764K_D796Y_Q954H_N969K); EU.1.1 | 201 | 220 |
| 124 | S_stab_PP(K986P_V987P_E180V) | | |
| 125 | S_stab_PP(K986P_V987P_R21G) | | |
| 126 | S_stab_PP(K986P_V987P_H146K) | | |
| 127 | S_stab_PP(K986P_V987P_G184V) | | |
| 128 | S_stab_PP(K986P_V987P_N185D) | | |
| 129 | S_stab_PP(K986P_V987P_F186L) | | |
| 130 | S_stab_PP(K986P_V987P_P521S) | | |
| 131 | S_stab_PP(K986P_V987P_Q613H) | | |
| 132 | S_stab_PP(K986P_V987P_T883I) | | |
| 133 | S_stab_PP(K986P_V987P_E1144Q) | | |
| 134 | S_stab_PP(K986P_V987P_C1243F) | | |
| 135 | S_stab_PP(K986P_V987P_D80Y) | | |
| 136 | S_stab_PP(K986P_V987P_D215H) | | |
| 137 | S_stab_PP(K986P_V987P_T547I) | | |
| 138 | S_stab_PP(K986P_V987P_I410V) | | |
| 139 | S_stab_PP(K986P_V987P_E180V_T478R_F486P) | | |
| 140 | S_stab_PP(K986P_V987P_K444T_L452R) | | |
| 141 | S_stab_PP(K986P_V987P_E180V_N460K) | | |
| 142 | S_stab_PP(K986P_V987P_R21G_N440K) | | |
| 143 | S_stab_PP(K986P_V987P_H146K_N460K) | | |
| 144 | S_stab_PP(K986P_V987P_G184V_N460K) | | |

TABLE 1-continued

Preferred SARS-COV-2 constructs (amino acid sequences and nucleic acid coding sequences):

| row | A | B | C |
|---|---|---|---|
| 145 | S_stab_PP(K986P_V987P_N185D_N460K) | | |
| 146 | S_stab_PP(K986P_V987P_F186L_N440K) | | |
| 147 | S_stab_PP(K986P_V987P_P521S_N460K) | | |
| 148 | S_stab_PP(K986P_V987P_Q613H_N460K) | | |
| 149 | S_stab_PP(K986P_V987P_T883I_N460K) | | |
| 150 | S_stab_PP(K986P_V987P_E1144Q_N460K) | | |
| 151 | S_stab_PP(K986P_V987P_C1243F_N440K) | | |
| 152 | S_stab_PP(K986P_V987P_D80Y_N460K) | | |
| 153 | S_stab_PP(K986P_V987P_D215H_N440K) | | |
| 154 | S_stab_PP(K986P_V987P_T547I_N460K) | | |
| 155 | S_stab_PP(K986P_V987P_I410V_N460K) | | |
| 156 | S_stab_PP(K986P_V987P_E180V_T478R_F486P) | | |
| 157 | S_stab_PP(K986P_V987P_K444T_L452R) | | |
| 158 | S_stab_PP(K986P_V987P_E180V_T478R_F486P_N460K) | | |
| 159 | S_stab_PP(K986P_V987P_K444T_L452R_N460K) | | |
| 160 | S_stab_PP(K986P_V987P_D215G_Q613H_N460K) | | |
| 161 | S_stab_PP(K986P_V987P_T19I_L24del_P25del_P26del_A27S_G142D_K147E_W152R_F157L_I210V_V213G_D215G_G257S_G339H_R346T_S371F_S373P_S375F_T376A_D405N_R408S_K417N_N440K_K444T_G446S_N460K_L452R_S477N_T478K_E484A_F486S_Q498R_N501Y_Y505H_Q613H_D614G_H655Y_N679K_P681H_N764K_D796Y_Q954H_N969K); FK.1 | | |
| 162 | S_stab_PP(K986P_V987P_T19I_L24del_P25del_P26del_A27S_Q52H_V83A_G142D_Y144del_H146Q_Q183E_V213G_G252V_G339H_R346T_L368I_S371F_S373P_S375F_T376A_D405N_R408S_K417N_N440K_V445P_G446S_F456L_N460K_S477N_T478K_E484A_F486P_F490S_Q498R_N501Y_Y505H_D614G_H655Y_N679K_P681H_N764K_D796Y_Q954H_N969K); EG.5.1 | 264 | 277 |
| 163 | S_stab_PP(K986P_V987P_T19I_L24del_P25del_P26del_A27S_V83A_G142D_Y144del_6H14Q_Q183E_V213G_G252V_G339H_R346T_L368I_S371F_S373P_S375F_T376A_D405N_R408S_K417N_N440K_V445P_G446S_F456L_N460K_S477N_T478K_E484A_F486P_F490S_Q498R_N501Y_Y505H_D614G_H655Y_N679K_P681H_N764K_D796Y_Q954H_N969K); EG.5 (FE.1/XBB.1.18.1.1) | 265 | 278 |
| 164 | S_stab_PP(K986P_V987P_T19I_L24del_P25del_P26del_A27S_V83A_G142D_Y144del_H146Q_K182N_Q183E_V213G_D253G_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_P521S_D614G_H655Y_N679K_P681H_N764K_D796Y_Q954H_N969K); XBB.2.3.3 | 266 | 279 |
| 165 | S_stab_PP(K986P_V987P_T19I_L24del_P25del_P26del_A27S_V83A_G142D_Y144del_H146Q_Q183E_V213G_D253G_G339H_R346T_L368I_S371F_S373P_S375F_T376A_D405N_R408S_K417N_N440K_V445P_G446S_N460K_S477N_T478Q_E484A_F486P_F490S_Q498R_N501Y_Y505H_P521S_D614G_H655Y_N679K_P681H_N764K_D796Y_Q954H_N969K); XBB.2.4 | 267 | 280 |
| 166 | S_stab_PP(K986P_V987P_T19I_L24del_P25del_P26del_A27S_V83A_G142D_Y144del_H146Q_Q183E_V213G_G252V_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_L518V_D614G_H655Y_N679K_P681H_N764K_D796Y_Q954H_N969K); GB.1 | 268 | 281 |
| 167 | S_stab_PP(K986P_V987P_T19I_L24del_P25del_P26del_A27S_V83A_G142D_Y144del_H146Q_Q183E_V213G_G252V_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_D614G_H655Y_N679K_P681H_A701V_N764K_D796Y_Q954H_N969K); FL.1(FL.1.3) | 269 | 282 |
| 168 | S_stab_PP(K986P_V987P_T19I_L24del_P25del_P26del_A27S_G142D_K147N_M153T_N164K_V213G_H245N_G257D_G339D_R346T_S371F_S373P_S375F_T376A_D405N_R408S_K417N_N440K_K444R_G446S_N450D_L452M_N460K_S477N_T478K_E484R_F486S_Q498R_N501Y_Y505H_D614G_H655Y_N679K_P681H_N764K_D796Y_Q954H_N969K); FV.1 | 270 | 283 |
| 169 | S_stab_PP(K986P_V987P_T19I_L24del_P25del_P26del_A27S_V83A_G142D_Y144del_H146Q_E180V_Q183E_V213G_G252V_G339H_R346T_L368I_S371F_S373P_S375F_T376A_D405N_R408S_K417N_N440K_V445P_G446S_F456L_N460K_S477N_T478R_E484A_F486P_F490S_Q498R_N501Y_Y505H_D614G_H655Y_N679K_P681H_N764K_D796Y_Q954H_N969K); XBB.1.16.6 | 271 | 284 |
| 170 | S_stab_PP(K986P_V987P_T19I_L24del_P25del_P26del_A27S_V83A_G142D_Y144del_H146Q_Q183E_V213G_G252V_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_E554K_D614G_H655Y_N679K_P681H_N764K_D796Y_Q954H_N969K); XBB.1.19.1 | 272 | 285 |
| 171 | S_stab_PP(K986P_V987P_T19I_L24del_P25del_P26del_A27S_V83A_G142D_Y144del_H146Q_Q183E_Y200C_V213E_G252V_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_D614G_H655Y_N679K_P681H_N764K_D796Y_Q954H_N969K); XBB.1.22.1 | 273 | 286 |
| 172 | S_stab_PP(K986P_V987P_T19I_L24del_P25del_P26del_A27S_V83A_G142D_Y144del_H146Q_Q183E_V213G_G252V_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_D614G_H655Y_Q675H_N679K_P681H_N764K_D796Y_Q954H_N969K); EL.1 | 274 | 287 |
| 173 | S_stab_PP(K986P_V987P_L18F_T19R_R21G_T95I_G142D_W152L_E156G_F157del_R158del_F186L_V213G_D253G_G339G_R346T_S371F_S373P_S375F_T376A_D405N_ | 275 | 288 |

TABLE 1-continued

Preferred SARS-COV-2 constructs (amino acid sequences and nucleic acid coding sequences):

| row | A | B | C |
|---|---|---|---|
| | R408S_K417N_N440K_G446D_L452R_S477N_T478K_E484A_F486P_Q498R_N501Y_Y505H_D614G_P621S_H655Y_N679K_P681H_A706V_N764K_D796Y_Q954H_N969K_T1117I_D1153Y); XAY.1.1.1 | | |
| 174 | S_stab_PP(K986P_V987P_T19I_L24del_P25del_P26del_A27S_V83A_G142D_Y144del_H146Q_Q183E_V213E_G252V_G339H_R346T_K356T_L368I_S371F_S373P_S375F_T376A_D405N_R408S_K417N_N440K_V445P_G446S_N460K_S477N_T478K_E484A_F486P_F490S_Q498R_N501Y_Y505H_T572I_D614G_H655Y_N679K_P681H_N764K_D796Y_Q954H_N969K); XBB.1.5.44 | 276 | 289 |
| 175 | S_stab_PP(K986P_V987P_K182N) | | |
| 176 | S_stab_PP(K986P_V987P_Y200C) | | |
| 177 | S_stab_PP(K986P_V987P_Q675H) | | |
| 178 | S_stab_PP(K986P_V987P_L518V) | | |
| 179 | S_stab_PP(K986P_V987P_E554K) | | |
| 180 | S_stab_PP(K986P_V987P_T572I) | | |
| 181 | S_stab_PP(K986P_V987P_D1153Y) | | |
| 182 | S_stab_PP(K986P_V987P_K182N_N460K) | | |
| 183 | S_stab_PP(K986P_V987P_Y200C_N460K) | | |
| 184 | S_stab_PP(K986P_V987P_Q675H_N460K) | | |
| 185 | S_stab_PP(K986P_V987P_L518V_N460K) | | |
| 186 | S_stab_PP(K986P_V987P_E554K_N460K) | | |
| 187 | S_stab_PP(K986P_V987P_T572I_N460K) | | |
| 188 | S_stab_PP(K986P_V987P_D1153Y_D614G) | | |
| 189 | S_stab_PP(K986P_V987P_K182N_N460K_D614G) | | |
| 190 | S_stab_PP(K986P_V987P_Y200C_N460K_D614G) | | |
| 191 | S_stab_PP(K986P_V987P_Q675H_N460K_D614G) | | |
| 192 | S_stab_PP(K986P_V987P_L518V_N460K_D614G) | | |
| 193 | S_stab_PP(K986P_V987P_E554K_N460K_D614G) | | |
| 194 | S_stab_PP(K986P_V987P_T572I_N460K_D614G) | | |

Suitable Coding Sequences:

In embodiments, the RNA of the invention comprises at least one coding sequence encoding at least one antigenic peptide or protein selected from or derived from a SARS-CoV-2 spike protein, or fragments and variants thereof. In that context, any coding sequence encoding at least one antigenic protein SARS-CoV-2 spike protein as defined herein, or fragments and variants thereof may be understood as suitable coding sequence and may therefore be comprised in the RNA of the invention.

In embodiments, the RNA of the first aspect may comprise or consist of at least one coding sequence encoding at least one antigenic peptide or protein from SARS-CoV-2 as defined herein, encoding any one of SEQ ID NOs: 1-2, 45-67, 159-164, 183-201, 264-276 or fragments or variants thereof. It has to be understood that, on nucleic acid level, any RNA sequence which encodes an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 68-101, 165-170, 202-220, 259-263, 277-289 or fragments or variants thereof, may be selected and may accordingly be understood as suitable coding sequence of the invention. In certain embodiments the RNA sequence which encodes a SARS-CoV-2 spike protein is at least 95% identical to any one of SEQ ID NOs: 68-101 or 165-170, 202-220, 259-263 or 277-289, respectively.

In some embodiments, the RNA sequence of SEQ ID NO: 259 may be referred as to the CAS number 2887554-49-4, further defined as [RNA (recombinant 5'-[1,2-[(3'-O-methyl) m7G-(5'→5')-ppp-Am]]-capped all uridine→N1-methylpseudouridine-substituted severe acute respiratory syndrome coronavirus 2 spike glycoprotein secretory signal peptide plus codon-optimized pre-fusion spike glycoprotein omicron XBB.1.5 variant [982-proline,983-proline]-specifying plus 5'- and 3'-untranslated flanking region-containing poly(A)-tailed messenger RBP020.24), inner salt (ACI)].

In some embodiments, the RNA sequence of SEQ ID NO: 262 may be referred as to the CAS number 2918977-08-7, further defined as [RNA (recombinant 5'-(m7G-(5'→5')-ppp-Gm)-capped all uridine→N1-methylpseudouridine-substituted severe acute respiratory syndrome coronavirus 2 pre-fusion spike glycoprotein [982-proline,983-proline] XBB.1.5 variant plus 5'- and 3'-untranslated flanking region-containing poly(A)-tailed messenger CX-038839), inner salt (ACI)].

In preferred embodiments, the RNA of the first aspect may comprise or consist of at least one coding sequence encoding at least one antigenic peptide or protein from SARS-CoV-2 as defined herein, encoding any one of SEQ ID NOs: 45-55, 159-164, 183-201, 264-276 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 70-80, 165-170, 202-220, 259-263, 277-289 or fragments or variants thereof, may be selected and may accordingly be understood as suitable coding sequence of the invention. In certain embodiments the RNA sequence which encodes a SARS-CoV-2 spike protein is at least 95% identical to any one of SEQ ID NOs: 70-94 or 165-170, 202-220 or 259-263, 277-289, respectively.

In embodiments, the RNA of the first aspect may comprise or consist of at least one coding sequence encoding at least one antigenic peptide or protein from SARS-CoV-2 as defined herein, encoding SEQ ID NO: 2 comprising at least one amino acid substitution, deletion or insertion according to the invention or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 82 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 82.

In preferred embodiments, the RNA of the first aspect may comprise or consist of at least one coding sequence encoding at least one antigenic peptide or protein from SARS-CoV-2 as defined herein, preferably encoding SEQ ID NO: 2 comprising at least one amino acid substitution, deletion or insertion according to the invention or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 95 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 95.

In embodiments, the RNA of the first aspect may comprise or consist of at least one coding sequence encoding at least one antigenic peptide or protein from SARS-CoV-2 as defined herein, encoding SEQ ID NO: 2 comprising at least one amino acid substitution, deletion or insertion according to the invention or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 99 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 99.

In embodiments, the RNA of the first aspect may comprise or consist of at least one coding sequence encoding at least one antigenic peptide or protein from SARS-CoV-2 as defined herein, encoding SEQ ID NO: 45 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 70 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 70.

In embodiments, the RNA of the first aspect may comprise or consist of at least one coding sequence encoding at least one antigenic peptide or protein from SARS-CoV-2 as defined herein, encoding SEQ ID NO: 46 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 71 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 71.

In embodiments, the RNA of the first aspect may comprise or consist of at least one coding sequence encoding at least one antigenic peptide or protein from SARS-CoV-2 as defined herein, encoding SEQ ID NO: 47 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 72 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 72.

In embodiments, the RNA of the first aspect may comprise or consist of at least one coding sequence encoding at least one antigenic peptide or protein from SARS-CoV-2 as defined herein, encoding SEQ ID NO: 48 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 73 or fragments or variants thereof, may be selected and may accordingly be understood as suitable coding sequence of the invention. In certain embodiments the RNA sequence which encodes a SARS-CoV-2 spike protein is at least 95% identical to any one of SEQ ID NO: 73.

In embodiments, the RNA of the first aspect may comprise or consist of at least one coding sequence encoding at least one antigenic peptide or protein from SARS-CoV-2 as defined herein, encoding SEQ ID NO: 49 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 74 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 74.

In embodiments, the RNA of the first aspect may comprise or consist of at least one coding sequence encoding at least one antigenic peptide or protein from SARS-CoV-2 as defined herein, encoding SEQ ID NO: 50 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 75 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 75.

In embodiments, the RNA of the first aspect may comprise or consist of at least one coding sequence encoding at least one antigenic peptide or protein from SARS-CoV-2 as defined herein, encoding SEQ ID NO: 51 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 76 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 76.

In embodiments, the RNA of the first aspect may comprise or consist of at least one coding sequence encoding at least one antigenic peptide or protein from SARS-CoV-2 as defined herein, encoding SEQ ID NO: 52 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 77 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 77.

In embodiments, the RNA of the first aspect may comprise or consist of at least one coding sequence encoding at least one antigenic peptide or protein from SARS-CoV-2 as defined herein, encoding SEQ ID NO: 53 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 78 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 78.

In embodiments, the RNA of the first aspect may comprise or consist of at least one coding sequence encoding at least one antigenic peptide or protein from SARS-CoV-2 as defined herein, encoding SEQ ID NO: 54 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 79 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 79.

In embodiments, the RNA of the first aspect may comprise or consist of at least one coding sequence encoding at least one antigenic peptide or protein from SARS-CoV-2 as defined herein, encoding SEQ ID NOs: 55 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NOs: 80 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 80.

In embodiments, the RNA of the first aspect may comprise or consist of at least one coding sequence encoding at least one antigenic peptide or protein from SARS-CoV-2 as defined herein, encoding SEQ ID NO: 159 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 165 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 165.

In embodiments, the RNA of the first aspect may comprise or consist of at least one coding sequence encoding at least one antigenic peptide or protein from SARS-CoV-2 as defined herein, encoding SEQ ID NO: 160 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 166 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 166.

In embodiments, the RNA of the first aspect may comprise or consist of at least one coding sequence encoding at least one antigenic peptide or protein from SARS-CoV-2 as defined herein, encoding SEQ ID NO: 161 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 167 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 167.

In preferred embodiments, the RNA of the first aspect may comprise or consist of at least one coding sequence encoding at least one antigenic peptide or protein from SARS-CoV-2 as defined herein, preferably encoding any one of SEQ ID NO: 162 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NOs: 168 or 259, or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 168. In further embodiments the RNA sequence which encodes a SARS-CoV-2 spike protein is at least 95% identical to SEQ ID NO: 259.

In embodiments, the RNA of the first aspect may comprise or consist of at least one coding sequence encoding at least one antigenic peptide or protein from SARS-CoV-2 as defined herein, encoding SEQ ID NO: 163 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 169 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 169.

In embodiments, the RNA of the first aspect may comprise or consist of at least one coding sequence encoding at least one antigenic peptide or protein from SARS-CoV-2 as defined herein, encoding SEQ ID NO: 164 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 170 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 170.

In embodiments, the RNA of the first aspect may comprise or consist of at least one coding sequence encoding at least one antigenic peptide or protein from SARS-CoV-2 as defined herein, encoding SEQ ID NO: 183 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 202 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 202.

In embodiments, the RNA of the first aspect may comprise or consist of at least one coding sequence encoding at least one antigenic peptide or protein from SARS-CoV-2 as defined herein, encoding any one of SEQ ID NO: 184 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 203 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 203.

In embodiments, the RNA of the first aspect may comprise or consist of at least one coding sequence encoding at least one antigenic peptide or protein from SARS-CoV-2 as defined herein, encoding SEQ ID NO: 185 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 204 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 204.

In embodiments, the RNA of the first aspect may comprise or consist of at least one coding sequence encoding at least one antigenic peptide or protein from SARS-CoV-2 as defined herein, encoding SEQ ID NO: 186 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 205 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 205.

In embodiments, the RNA of the first aspect may comprise or consist of at least one coding sequence encoding at least one antigenic peptide or protein from SARS-CoV-2 as defined herein, encoding SEQ ID NO: 187 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 206 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 206.

In embodiments, the RNA of the first aspect may comprise or consist of at least one coding sequence encoding at least one antigenic peptide or protein from SARS-CoV-2 as defined herein, encoding SEQ ID NO: 188 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 207 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 207.

In embodiments, the RNA of the first aspect may comprise or consist of at least one coding sequence encoding at least one antigenic peptide or protein from SARS-CoV-2 as defined herein, encoding SEQ ID NO: 189 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 208 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 208.

In embodiments, the RNA of the first aspect may comprise or consist of at least one coding sequence encoding at least one antigenic peptide or protein from SARS-CoV-2 as defined herein, encoding SEQ ID NO: 190 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 209 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 209.

In embodiments, the RNA of the first aspect may comprise or consist of at least one coding sequence encoding at least one antigenic peptide or protein from SARS-CoV-2 as defined herein, encoding SEQ ID NO: 191 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 210 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 210.

In embodiments, the RNA of the first aspect may comprise or consist of at least one coding sequence encoding at least one antigenic peptide or protein from SARS-CoV-2 as defined herein, encoding SEQ ID NO: 192 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 211 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 211.

In embodiments, the RNA of the first aspect may comprise or consist of at least one coding sequence encoding at least one antigenic peptide or protein from SARS-CoV-2 as defined herein, encoding SEQ ID NO: 193 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 212 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 212.

In embodiments, the RNA of the first aspect may comprise or consist of at least one coding sequence encoding at least one antigenic peptide or protein from SARS-CoV-2 as defined herein, encoding SEQ ID NO: 194 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 213 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 213.

In embodiments, the RNA of the first aspect may comprise or consist of at least one coding sequence encoding at least one antigenic peptide or protein from SARS-CoV-2 as defined herein, encoding SEQ ID NO: 195 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 214 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 214.

In embodiments, the RNA of the first aspect may comprise or consist of at least one coding sequence encoding at least one antigenic peptide or protein from SARS-CoV-2 as defined herein, encoding SEQ ID NO: 196 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 215 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 215.

In embodiments, the RNA of the first aspect may comprise or consist of at least one coding sequence encoding at least one antigenic peptide or protein from SARS-CoV-2 as defined herein, encoding SEQ ID NO: 197 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 216 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 216.

In embodiments, the RNA of the first aspect may comprise or consist of at least one coding sequence encoding at least one antigenic peptide or protein from SARS-CoV-2 as defined herein, encoding SEQ ID NO: 198 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 217 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 217.

In embodiments, the RNA of the first aspect may comprise or consist of at least one coding sequence encoding at least one antigenic peptide or protein from SARS-CoV-2 as defined herein, encoding SEQ ID NO: 199 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 218 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 218.

In embodiments, the RNA of the first aspect may comprise or consist of at least one coding sequence encoding at least one antigenic peptide or protein from SARS-CoV-2 as defined herein, encoding SEQ ID NO: 200 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 219 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 219.

In embodiments, the RNA of the first aspect may comprise or consist of at least one coding sequence encoding at least one antigenic peptide or protein from SARS-CoV-2 as defined herein, encoding SEQ ID NO: 201 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 220 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 220.

In embodiments, the RNA of the first aspect may comprise or consist of at least one coding sequence encoding at least one antigenic peptide or protein from SARS-CoV-2 as defined herein, encoding SEQ ID NO: 264 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 277 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 277.

In embodiments, the RNA of the first aspect may comprise or consist of at least one coding sequence encoding at least one antigenic peptide or protein from SARS-CoV-2 as defined herein, SEQ ID NO: 265 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 278 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 278.

In embodiments, the RNA of the first aspect may comprise or consist of at least one coding sequence encoding at least one antigenic peptide or protein from SARS-CoV-2 as defined herein, encoding SEQ ID NO: 266 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 279 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 279.

In embodiments, the RNA of the first aspect may comprise or consist of at least one coding sequence encoding at least one antigenic peptide or protein from SARS-CoV-2 as defined herein, encoding SEQ ID NO: 267 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 280 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 280.

In embodiments, the RNA of the first aspect may comprise or consist of at least one coding sequence encoding at least one antigenic peptide or protein from SARS-CoV-2 as defined herein, encoding SEQ ID NO: 268 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 281 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 281.

In embodiments, the RNA of the first aspect may comprise or consist of at least one coding sequence encoding at least one antigenic peptide or protein from SARS-CoV-2 as defined herein, encoding SEQ ID NO: 269 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 282 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 282.

In embodiments, the RNA of the first aspect may comprise or consist of at least one coding sequence encoding at least one antigenic peptide or protein from SARS-CoV-2 as defined herein, encoding SEQ ID NO: 270 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 283 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 283.

In embodiments, the RNA of the first aspect may comprise or consist of at least one coding sequence encoding at least one antigenic peptide or protein from SARS-CoV-2 as defined herein, encoding SEQ ID NO: 271 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 284 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 284.

In embodiments, the RNA of the first aspect may comprise or consist of at least one coding sequence encoding at least one antigenic peptide or protein from SARS-CoV-2 as defined herein, encoding SEQ ID NO: 272 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 285 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 285.

In embodiments, the RNA of the first aspect may comprise or consist of at least one coding sequence encoding at least one antigenic peptide or protein from SARS-CoV-2 as defined herein, encoding SEQ ID NO: 273 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 286 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 286.

In embodiments, the RNA of the first aspect may comprise or consist of at least one coding sequence encoding at least one antigenic peptide or protein from SARS-CoV-2 as defined herein, encoding SEQ ID NO: 274 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 287 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 287.

In embodiments, the RNA of the first aspect may comprise or consist of at least one coding sequence encoding at least one antigenic peptide or protein from SARS-CoV-2 as defined herein, encoding SEQ ID NO: 275 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 288 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 288.

In embodiments, the RNA of the first aspect may comprise or consist of at least one coding sequence encoding at least one antigenic peptide or protein from SARS-CoV-2 as defined herein, encoding SEQ ID NO: 276 or fragments or variants thereof. It has to be understood that, on nucleic acid level, any RNA sequence which encodes an amino acid sequences being identical or at least 70%, 80%, 85%, 86%, 87%, 88%, 89%, 90%, 91%, 92%, 93%, 94%, 95%, 96%, 97%, 98%, or 99% identical to SEQ ID NO: 289 or fragments or variants thereof, may be selected and may accordingly be understood as suitable coding sequence of the invention. In certain embodiments the RNA sequence which encodes a SARS-CoV-2 spike protein is at least 95% identical to SEQ ID NO: 289.

In embodiments, the RNA of the first aspect is an artificial RNA.

The term "artificial RNA" as used herein is intended to refer to an RNA that does not occur naturally. In other words, an artificial RNA may be understood as a non-natural RNA molecule. Such RNA molecules may be non-natural due to its individual sequence (e.g. G/C content modified coding sequence, UTRs) and/or due to other modifications, e.g. structural modifications of nucleotides. Typically, artificial RNA may be designed and/or generated by genetic engineering to correspond to a desired artificial sequence of nucleotides. In this context, an artificial RNA is a sequence that may not occur naturally, i.e. a sequence that differs from the wild type sequence/the naturally occurring sequence by at least one nucleotide. In this context the term "reference coding sequence" may be used as well. The term "artificial RNA" is not restricted to mean "one single RNA molecule" but is understood to comprise an ensemble of essentially identical RNA molecules. Accordingly, it may relate to a plurality of essentially identical RNA molecules.

A suitable reference coding sequence encoding e.g. the protein reference sequence of SEQ ID NO: 1 is SEQ ID NO 68. A suitable reference coding sequence encoding e.g. the protein reference sequence of SEQ ID NO: 2 (Stab-PP) is SEQ ID NO 68. Reference coding sequences encoding the proteins according to invention comprises the amino acid substitutions, deletions, or insertions according to the invention.

In preferred embodiments, the RNA of the first aspect is a modified and/or stabilized RNA.

In embodiments, the RNA of the present invention may thus be provided as a "stabilized artificial RNA" or "stabilized coding RNA" that is to say an RNA showing improved resistance to in vivo degradation and/or an RNA showing improved stability in vivo, and/or an RNA showing improved translatability in vivo. In the following, specific suitable modifications/adaptations in this context are described which are suitably to "stabilize" the RNA. In embodiments, the RNA of the present invention may be provided as a "stabilized RNA" or "stabilized coding RNA".

Such stabilization may be affected by providing a "dried RNA" and/or a "purified RNA" as further specified below. Alternatively, or in addition to that, such stabilization can be affected, for example, by a modified phosphate backbone of the RNA of the present invention. A backbone modification in connection with the present invention is a modification in which phosphates of the backbone of the nucleotides contained in the nucleic acid are chemically modified. Nucleotides that may be used in this connection contain e.g. a phosphorothioate-modified phosphate backbone, preferably at least one of the phosphate oxygens contained in the phosphate backbone being replaced by a sulfur atom. Stabilized RNAs may further include, for example: non-ionic phosphate analogues, such as, for example, alkyl and aryl phosphonates, in which the charged phosphonate oxygen is replaced by an alkyl or aryl group, or phosphodiesters and alkylphosphotriesters, in which the charged oxygen residue is present in alkylated form. Such backbone modifications typically include, without implying any limitation, modifications from the group consisting of methylphosphonates, phosphoramidates and phosphorothioates (e.g. cytidine-5'-O-(1-thiophosphate)).

In the following, suitable modifications are described that are capable of "stabilizing" the RNA of the invention.

In preferred embodiments, the RNA comprises at least one codon modified coding sequence.

The term "codon modified coding sequence" relates to coding sequences that differ in at least one codon (triplets of nucleotides coding for one amino acid) compared to the corresponding reference coding sequence encoding the same polypeptide. Suitably, a codon modified coding sequence in the context of the invention may show improved resistance to in vivo degradation and/or improved stability in vivo, and/or improved translatability in vivo. Codon modifications in the broadest sense make use of the degeneracy of the genetic code wherein multiple codons may encode the same amino acid and may be used interchangeably to optimize/modify the coding sequence for in vivo applications.

The term "reference coding sequence" refers to the coding sequence, which was the origin sequence to be modified and/or optimized (e.g., by increasing G/C content or codon modification).

In preferred embodiments, the at least one coding sequence of the RNA is a codon modified coding sequence, wherein the codon modified coding sequence is selected from C maximized coding sequence, CAI maximized coding sequence, human codon usage adapted coding sequence, G/C content modified coding sequence, and G/C optimized coding sequence, or any combination thereof.

In embodiments, the at least one coding sequence of the RNA has a G/C content of at least about 50%, 55%, or 60%. In particular embodiments, the at least one coding sequence of the RNA of component A has a G/C content of at least about 50%, 51%, 52%, 53%, 54%, 55%, 56%, 57%, 58%, 59%, 60%, 61%, 62%, 63%, 64%, 65%, 66%, 67%, 68%, 69%, or 70%.

When transfected into mammalian host cells, the RNA comprising a codon modified coding sequence has a stability of between 12-18 hours, or greater than 18 hours, e.g., 24, 36, 48, 60, 72, or greater than 72 hours and are capable of being expressed by the mammalian host cell (e.g. a muscle cell).

When transfected into mammalian host cells, the RNA comprising a codon modified coding sequence is translated into protein, wherein the amount of protein is at least comparable to, or at least 10% more than, or at least 20% more than, or at least 30% more than, or at least 40% more than, or at least 50% more than, or at least 100% more than, or at least 200% or more than the amount of protein obtained by a naturally occurring or reference coding sequence transfected into mammalian host cells.

In some embodiments, the RNA may be modified, wherein the C content of the at least one coding sequence may be increased, or maximized, compared to the C content of the corresponding reference coding sequence (herein referred to as "C maximized coding sequence"). The generation of a C maximized nucleic acid sequences may suitably be carried out using a modification method according to WO2015/062738. In this context, the disclosure of WO2015/062738 is included herewith by reference.

In embodiments, the RNA may be modified, wherein the G/C content of the at least one coding sequence may be optimized compared to the G/C content of the corresponding reference coding sequence (herein referred to as "G/C content optimized coding sequence"). "Optimized" in that context refers to a coding sequence wherein the G/C content is increased to the essentially highest possible G/C content. The generation of a G/C content optimized RNA sequences may be carried out using a method according to WO2002/098443. In this context, the disclosure of WO2002/098443 is included in its full scope in the present invention. Throughout the description, including sequence listing, G/C optimized coding sequences are indicated by the abbreviations "opt1" or "gc".

In embodiments, the RNA may be modified, wherein the codons in the at least one coding sequence may be adapted to human codon usage (herein referred to as "human codon usage adapted coding sequence"). Codons encoding the same amino acid occur at different frequencies in humans. Accordingly, the coding sequence of the nucleic acid is modified such that the frequency of the codons encoding the same amino acid corresponds to the naturally occurring frequency of that codon according to the human codon usage. For example, in the case of the amino acid Ala, the reference coding sequence is preferably adapted in a way that the codon "GCC" is used with a frequency of 0.40, the codon "GCT" is used with a frequency of 0.28, the codon "GCA" is used with a frequency of 0.22 and the codon "GCG" is used with a frequency of 0.10 etc. Accordingly, such a procedure (as exemplified for Ala) is applied for each amino acid encoded by the coding sequence of the nucleic acid to obtain sequences adapted to human codon usage. Throughout the description, including the sequence listing, human codon usage adapted coding sequences are indicated by the abbreviation "opt3" or "human".

In some embodiments, the RNA may be modified, wherein the G/C content of the at least one coding sequence may be modified compared to the G/C content of the corresponding reference coding sequence (herein referred to as "G/C content modified coding sequence"). In this context, the terms "G/C optimization" or "G/C content modification" relate to a nucleic acid that comprises a modified, an increased number of guanosine and/or cytosine nucleotides as compared to the corresponding reference coding sequence. Such an increased number may be generated by substitution of codons containing adenosine or thymidine nucleotides by codons containing guanosine or cytosine nucleotides. Advantageously, nucleic acid sequences having an increased G/C content are more stable or show a better expression than sequences having an increased A/U. In embodiments, the G/C content of the coding sequence of the nucleic acid is increased by at least 10%, 20%, 30%, by at least 40% compared to the G/C content of the coding sequence of the corresponding wild type or reference nucleic acid sequence (herein referred to "opt 10" or "gc mod"). For example, the the G/C content of the coding sequence of the nucleic acid is preferably increased by at least 10%, 15%, 16%, 17%, 18%, 19%, 20%, 21%, 22%, 23%, 24% or 25% relative to the G/C content of SEQ ID NO: 81.

In some embodiments, the RNA may be modified, wherein the codon adaptation index (CAI) may be increased or maximised in the at least one coding sequence (herein referred to as "CAI maximized coding sequence"). In embodiments, all codons of the reference nucleic acid sequence that are relatively rare in e.g. a human are exchanged for a respective codon that is frequent in the e.g. a human, wherein the frequent codon encodes the same amino acid as the relatively rare codon. Suitably, the most frequent codons are used for each amino acid of the encoded protein. Suitably, the RNA comprises at least one coding sequence, wherein the codon adaptation index (CAI) of the at least one coding sequence is at least 0.5, at least 0.8, at least 0.9 or at least 0.95. Most preferably, the codon adaptation index (CAI) of the at least one coding sequence is 1 (CAI=1). For example, in the case of the amino acid Ala, the reference coding sequence may be adapted in a way that the most frequent human codon "GCC" is always used for said amino acid. Accordingly, such a procedure (as exemplified for Ala) may be applied for each amino acid encoded by the coding sequence of the nucleic acid to obtain CAI maximized coding sequences.

In particularly preferred embodiments, the at least one coding sequence of the nucleic acid is a codon modified coding sequence, wherein the codon modified coding sequence is a G/C optimized coding sequence.

In embodiments, the RNA of the first aspect comprises at least one coding sequence comprising or consisting a G/C optimized coding sequence encoding the SARS-CoV-2 antigen as defined herein which is identical or at least 70%, 80%, 85%, 86%, 87%, 88%, 89%, 90%, 91%, 92%, 93%, 94%, 95%, 96%, 97%, 98%, or 99% identical to a G/C optimized nucleic acid sequence selected from the group consisting of SEQ ID NOs: 70-80, 165-179, 202-220, 259-263, 277-289 or a fragment or variant of any of these sequences.

UTRs:

In preferred embodiments, the RNA of the invention comprises at least one coding sequence encoding at least one SARS-CoV-2 spike protein as defined herein, or an immunogenic fragment or immunogenic variant thereof, wherein the RNA comprises at least one heterologous untranslated region (UTR).

In embodiments, the RNA of the invention comprises a protein-coding region ("coding sequence" or "cds"), and 5'-UTR and/or 3'-UTR. Notably, UTRs may harbor regulatory sequence elements that determine nucleic acid, e.g. RNA turnover, stability, and localization. Moreover, UTRs may harbor sequence elements that enhance translation. In medical applications, translation of the RNA into at least one peptide or protein is of paramount importance to therapeutic efficacy. Certain combinations of 3'-UTRs and/or 5'-UTRs may enhance the expression of operably linked coding sequences encoding peptides or proteins of the invention. RNA molecules harboring said UTR combinations advantageously enable rapid and transient expression of antigenic peptides or proteins after administration to a subject, such as after intramuscular administration. Accordingly, the RNA comprising certain combinations of 3'-UTRs and/or 5'-UTRs as provided herein is particularly suitable for administration as a vaccine, in particular, suitable for administration into the muscle, the dermis, or the epidermis of a subject.

Suitably, the RNA of the invention comprises at least one heterologous 5'-UTR and/or at least one heterologous 3'-UTR. Said heterologous 5'-UTRs or 3'-UTRs may be derived from naturally occurring genes or may be synthetically engineered. In embodiments, the RNA comprises at least one coding sequence as defined herein operably linked to at least one (heterologous) 3'-UTR and/or at least one (heterologous) 5'-UTR.

In preferred embodiments, the RNA comprises at least one heterologous 3'-UTR. In embodiments, the RNA comprises a 3'-UTR, which may be derivable from a gene that relates to an RNA with enhanced half-life (i.e. that provides a stable RNA).

In some embodiments, a 3'-UTR comprises one or more of a polyadenylation signal, a binding site for proteins that affect a nucleic acid stability or location in a cell, or one or more miRNA or binding sites for miRNAs.

MicroRNAs (or miRNA) are 19-25 nucleotide long noncoding RNAs that bind to the 3'-UTR of nucleic acid molecules and down-regulate gene expression either by reducing nucleic acid molecule stability or by inhibiting translation. E.g., microRNAs are known to regulate RNA, and thereby protein expression, e.g. in liver (miR-122), heart (miR-Id, miR-149), endothelial cells (miR-17-92, miR-126), adipose tissue (let-7, miR-30c), kidney (miR-192, miR-194, miR-204), myeloid cells (miR-142-3p, miR-142-5p, miR-16, miR-21, miR-223, miR-24, miR-27), muscle (miR-133, miR-206, miR-208), and lung epithelial cells (let-7, miR-133, miR-126). The RNA may comprise one or more microRNA target sequences, microRNA sequences, or microRNA seeds. Such sequences may e.g. correspond to any known microRNA such as those taught in US2005/0261218 and US2005/0059005.

Accordingly, miRNA, or binding sites for miRNAs as defined above, may be removed from the 3'-UTR or introduced into the 3'-UTR in order to tailor the expression of the RNA to desired cell types or tissues (e.g. muscle cells).

In embodiments, the RNA comprises at least one heterologous 3'-UTR that comprises or consists of a nucleic acid sequence derived from a 3'-UTR of a gene selected from PSMB3, ALB7, CASP1, COX6B1, GNAS, NDUFA1 and RPS9, or from a homolog, a fragment or a variant of any one of these genes. In some embodiments, the RNA comprises at least one heterologous 3'-UTR, wherein the at least one heterologous 3'-UTR comprises a nucleic acid sequence derived from a 3'-UTR of a gene selected from PSMB3, ALB7, CASP1, COX6B1, GNAS, NDUFA1 and RPS9, or from a homolog, a fragment or variant of any one of these genes, preferably according to nucleic acid sequences being identical or at least 70%, 80%, 85%, 86%, 87%, 88%, 89%, 90%, 91%, 92%, 93%, 94%, 95%, 96%, 97%, 98%, or 99% identical to SEQ ID NOs: 253-266, 22902-22905, 22876-22895, 26996-26999, 28528-28539 of WO2022/137133, or a fragment or a variant of any of these. Nucleic acid sequences in that context can be derived from published PCT application WO2019/077001A1, in particular, claim 9 of WO2019/077001A1. The corresponding 3'-UTR sequences of claim 9 of WO2019/077001A1 are herewith incorporated by reference (e.g., SEQ ID NOs: 23-34 of WO2019/077001A1, or fragments or variants thereof).

In preferred embodiments, the RNA comprises a 3'-UTR derived from a PSMB3 gene. Said 3'-UTR derived from a PSMB3 gene may comprise or consist of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NOs: 19, 20, 21 or 22 or a fragment or a variant thereof.

In other embodiments, the RNA comprises a 3'-UTR which comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NOs: 23-36 or a fragment or a variant thereof.

In other embodiments, the RNA may comprise a 3'-UTR as described in WO2016/107877, the disclosure of WO2016/107877 relating to 3'-UTR sequences herewith incorporated by reference. Suitable 3'-UTRs are SEQ ID NOs: 1-24 and SEQ ID NOs: 49-318 of WO2016/107877, or fragments or variants of these sequences. In other embodiments, the nucleic acid comprises a 3'-UTR as described in WO2017/036580, the disclosure of WO2017/036580 relating to 3'-UTR sequences herewith incorporated by reference. Suitable 3'-UTRs are SEQ ID NOs: 152-204 of WO2017/036580, or fragments or variants of these sequences. In other embodiments, the nucleic acid comprises a 3'-UTR as described in WO2016/022914, the disclosure of WO2016/022914 relating to 3'-UTR sequences herewith incorporated by reference. In embodiments, the 3'-UTRs are nucleic acid sequences according to SEQ ID NOs: 20-36 of WO2016/022914, or fragments or variants of these sequences. In embodiments, the nucleic acid comprises a 3'-UTR as described in WO2022/137133, the disclosure of WO2022/137133 relating to 3'-UTR sequences is herewith incorporated by reference.

In preferred embodiments, the RNA comprises at least one heterologous 5'-UTR.

The terms "5'-untranslated region" or "5'-UTR" or "5'-UTR element" refer to a part of an RNA molecule located 5' (i.e. "upstream") of a coding sequence and which is not translated into protein. A 5'-UTR may be part of a nucleic acid located 5' of the coding sequence. Typically, a 5'-UTR starts with the transcriptional start site and ends before the start codon of the coding sequence. A 5'-UTR may comprise elements for controlling gene expression, also called regulatory elements. Such regulatory elements may be, e.g., ribosomal binding sites, miRNA binding sites etc. The 5'-UTR may be post-transcriptionally modified, e.g. by enzymatic or post-transcriptional addition of a 5'-cap structure (e.g. for mRNA).

Preferably, the RNA comprises a 5'-UTR which may be derivable from a gene that relates to an RNA with enhanced half-life (i.e. that provides a stable RNA).

In some embodiments, a 5'-UTR comprises one or more of a binding site for proteins that affect an RNA stability or RNA location in a cell, or one or more miRNA or binding sites for miRNAs (as defined above).

Accordingly, miRNA or binding sites for miRNAs as defined above may be removed from the 5'-UTR or introduced into the 5'-UTR in order to tailor the expression of the nucleic acid to desired cell types or tissues (e.g. muscle cells).

In embodiments, the RNA comprises at least one heterologous 5'-UTR, wherein the at least one heterologous 5'-UTR comprises a nucleic acid sequence derived from a 5'-UTR of gene selected from HSD17B4, RPL32, ASAH1, ATP5A1, MP68, NDUFA4, NOSIP, RPL31, SLC7A3, TUBB4B, and UBQLN2, or from a homolog, a fragment or variant of any one of these genes according to nucleic acid sequences being identical or at least 70%, 80%, 85%, 86%, 87%, 88%, 89%, 90%, 91%, 92%, 93%, 94%, 95%, 96%, 97%, 98%, or 99% identical to SEQ ID NOs: 231-252, 22870-22875 of WO2022/137133 or a fragment or a variant of any of these. Nucleic acid sequences in that context can be selected from published PCT application WO2019/077001A1, in particular, claim 9 of WO2019/077001A1. The corresponding 5'-UTR sequences of claim 9 of WO2019/077001A1 are herewith incorporated by reference (e.g., SEQ ID NOs: 1-20 of WO2019/077001A1, or fragments or variants thereof).

In preferred embodiments, the RNA comprises a 5'-UTR derived from a HSD17B4 gene, wherein said 5'-UTR derived from a HSD17B4 gene comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NOs: 3-6 or a fragment or a variant thereof.

In other embodiments, the RNA comprises a 5'-UTR which comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NOs: 7-18 or a fragment or a variant thereof.

In other embodiments, the RNA comprises a 5'-UTR as described in WO2013/143700, the disclosure of WO2013/143700 relating to 5'-UTR sequences herewith incorporated by reference. The 5'-UTRs are nucleic acid sequences derived from SEQ ID NOs: 1-1363, SEQ ID NO: 1395, SEQ ID NO: 1421 and SEQ ID NO: 1422 of WO2013/143700, or fragments or variants of these sequences. In other embodiments, the nucleic acid comprises a 5'-UTR as described in WO2016/107877, the disclosure of WO2016/107877 relating to 5'-UTR sequences herewith incorporated by reference. In embodiments, the 5'-UTRs are nucleic acid sequences according to SEQ ID NOs: 25-30 and SEQ ID NOs: 319-382 of WO2016/107877, or fragments or variants of these sequences. In other embodiments, the nucleic acid comprises a 5'-UTR as described in WO2017/036580, the disclosure of WO2017/036580 relating to 5'-UTR sequences herewith incorporated by reference. In embodiments, the 5'-UTRs are nucleic acid sequences according to SEQ ID NOs: 1-151 of WO2017/036580, or fragments or variants of these sequences. In other embodiments, the nucleic acid comprises a 5'-UTR as described in WO2016/022914, the disclosure of WO2016/022914 relating to 5'-UTR sequences herewith incorporated by reference. In embodiments, the 5'-UTRs are nucleic acid sequences according to SEQ ID NOs: 3-19 of WO2016/022914, or fragments or variants of these sequences. In embodiments, the nucleic acid comprises a 5'-UTR as described in WO2022/137133, the disclosure of WO2022/137133 relating to 5'-UTR sequences is herewith incorporated by reference.

Suitably, in embodiments, the RNA comprises at least one coding sequence as specified herein encoding at least one antigenic protein as defined herein, derived from SARS-CoV-2 operably linked to a 3'-UTR and/or a 5'-UTR selected from the following 5'UTR/3'UTR combinations ("also referred to UTR designs"):

a-1 (HSD17B4/PSMB3), a-2 (NDUFA4/PSMB3), a-3 (SLC7A3/PSMB3), a-4 (NOSIP/PSMB3), a-5 (MP68/PSMB3), b-1 (UBQLN2/RPS9), b-2 (ASAH1/RPS9), b-3 (HSD17B4/RPS9), b-4 (HSD17B4/CASP1), b-5 (NOSIP/COX6B1), c-1 (NDUFA4/RPS9), c-2 (NOSIP/NDUFA1), c-3 (NDUFA4/COX6B1), c-4 (NDUFA4/NDUFA1), c-5 (ATP5A1/PSMB3), d-1 (Rpl31/PSMB3), d-2 (ATP5A1/CASP1), d-3 (SLC7A3/GNAS), d-4 (HSD17B4/NDUFA1), d-5 (Slc7a3/Ndufa1), e-1 (TUBB4B/RPS9), e-2 (RPL31/RPS9), e-3 (MP68/RPS9), e-4 (NOSIP/RPS9), e-5 (ATP5A1/RPS9), e-6 (ATP5A1/COX6B1), f-1 (ATP5A1/GNAS), f-2 (ATP5A1/NDUFA1), f-3 (HSD17B4/COX6B1), f-4 (HSD17B4/GNAS), f-5 (MP68/COX6B1), g-1 (MP68/NDUFA1), g-2 (NDUFA4/CASP1), g-3 (NDUFA4/GNAS), g-4 (NOSIP/CASP1), g-5 (RPL31/CASP1), h-1 (RPL31/COX6B1), h-2 (RPL31/GNAS), h-3 (RPL31/NDUFA1), h-4 (Slc7a3/CASP1), h-5 (SLC7A3/COX6B1), i-1 (SLC7A3/RPS9), i-2 (RPL32/ALB7), i-2 (RPL32/ALB7).

In particularly preferred embodiments, the RNA comprises at least one coding sequence as specified herein encoding at least one antigenic protein derived from SARS-CoV-2, wherein said coding sequence is operably linked to a HSD17B4 5'-UTR and a PSMB3 3'-UTR (HSD17B4/PSMB3 (UTR design a-1)).

It has been shown by the inventors that this embodiment is particularly beneficial for induction an immune response against SARS-CoV-2. In this context, it was shown that already one vaccination was sufficient to result in virus-neutralizing antibody titers.

In some embodiments, the RNA may be monocistronic, bicistronic, or multicistronic.

The term "monocistronic" refers to a nucleic acid that comprises only one coding sequence. The terms "bicistronic", or "multicistronic" as used herein refer to a nucleic acid that may comprise two (bicistronic) or more (multicistronic) coding sequences.

In embodiments, the RNA of the first aspect is monocistronic.

In other embodiments, the RNA is monocistronic and the coding sequence of said nucleic acid encodes at least two different antigenic peptides or proteins derived from a SARS-CoV-2. Accordingly, said coding sequence may encode at least two, three, four, five, six, seven, eight and more antigenic peptides or proteins derived from a SARS-CoV-2, linked with or without an amino acid linker sequence, wherein said linker sequence can comprise rigid linkers, flexible linkers, cleavable linkers, or a combination thereof. Such constructs are herein referred to as "multi-antigen-constructs".

In further embodiments, the RNA may be bicistronic or multicistronic and comprises at least two coding sequences, wherein the at least two coding sequences encode two or more different antigenic peptides or proteins derived from a SARS-CoV-2. Accordingly, the coding sequences in a bicistronic or multicistronic nucleic acid suitably encodes distinct antigenic proteins or peptides as defined herein or immunogenic fragments or immunogenic variants thereof.

In embodiments, the coding sequences in said bicistronic or multicistronic constructs may be separated by at least one IRES (internal ribosomal entry site) sequence. Thus, the term "encoding two or more antigenic peptides or proteins" may mean, without being limited thereto, that the bicistronic or multicistronic nucleic acid encodes e.g. at least two, three, four, five, six or more (preferably different) antigenic peptides or proteins of different SARS-CoV-2 isolates. Alternatively, the bicistronic or multicistronic nucleic acid may encode e.g. at least two, three, four, five, six or more (preferably different) antigenic peptides or proteins derived from the same SARS-CoV-2. In that context, suitable IRES sequences may be selected from the list of nucleic acid sequences according to SEQ ID NOs: 1566-1662 of the patent application WO2017/081082, or fragments or variants of these sequences. In this context, the disclosure of WO2017/081082 relating to IRES sequences is herewith incorporated by reference.

It has to be understood that, in the context of the invention, certain combinations of coding sequences may be generated by any combination of monocistronic, bicistronic and multicistronic RNA constructs and/or multi-antigen-constructs to obtain a nucleic acid set encoding multiple antigenic peptides or proteins as defined herein.

In embodiments, the A/U (A/T) content in the environment of the ribosome binding site of the RNA may be increased compared to the A/U (A/T) content in the environment of the ribosome binding site of its respective wild type or reference RNA. This modification (an increased A/U (A/T) content around the ribosome binding site) increases the efficiency of ribosome binding to the RNA. An effective binding of the ribosomes to the ribosome binding site in turn has the effect of an efficient translation the RNA.

Accordingly, in embodiments, the RNA comprises a ribosome binding site, also referred to as "Kozak sequence", identical to or at least 80%, 85%, 90%, 95% identical to any one of the sequences SEQ ID NOs: 180, 181, 22845-22847 of WO2022/137133 or fragments or variants thereof. The disclosure of WO2022/137133 relating to Kozak sequences is herewith incorporated by reference.

In preferred embodiments, the RNA comprises at least one poly(N) sequence, e.g. at least one poly(A) sequence, at least one poly(U) sequence, at least one poly(C) sequence, or combinations thereof.

In preferred embodiments, the RNA of the invention comprises at least one poly(A) sequence.

The terms "poly(A) sequence", "poly(A) tail" or "3'-poly (A) tail" as used herein are e.g. intended to be a sequence of adenosine nucleotides, typically located at the 3'-end of a linear RNA (or in a circular RNA), of up to about 1000 adenosine nucleotides. In embodiments, said poly(A) sequence is essentially homopolymeric, e.g. a poly(A) sequence of e.g. 100 adenosine nucleotides has essentially the length of 100 nucleotides. In other embodiments, the poly(A) sequence is interrupted by at least one nucleotide different from an adenosine nucleotide, e.g. a poly(A) sequence of e.g. 100 adenosine nucleotides may have a length of more than 100 nucleotides (comprising 100 adenosine nucleotides and in addition said at least one nucleotide—or a stretch of nucleotides—different from an adenosine nucleotide).

The poly(A) sequence may comprise about 10 to about 500 adenosine nucleotides, about 10 to about 200 adenosine nucleotides, about 40 to about 200 adenosine nucleotides, or about 40 to about 150 adenosine nucleotides. Suitably, the length of the poly(A) sequence may be at least about or even more than about 10, 50, 64, 75, 100, 200, 300, 400, or 500 adenosine nucleotides. In certain embodiments the RNA comprises at least one poly(A) sequence comprising 30 to 200 adenosine nucleotides, wherein the 3' terminal nucleotide of said RNA is an adenosine.

In embodiments, the RNA of the invention comprises at least one poly(A) sequence comprising about 30 to about 200 adenosine nucleotides. In embodiments, the poly(A) sequence comprises about 64 adenosine nucleotides (A64). In embodiments, the poly(A) sequence comprises about 100 adenosine nucleotides (A100). In embodiments, the poly(A) sequence comprises at least 100 adenosine nucleotides (A100). In other embodiments, the poly(A) sequence comprises about 150 adenosine nucleotides.

In further embodiments, the RNA of the invention comprises at least one poly(A) sequence comprising about 100 adenosine nucleotides, wherein the poly(A) sequence is interrupted by a linker having no more than 2 consecutive adenosine nucleotides, (e.g. A30-N10-A70).

The poly(A) sequence as defined herein may be located directly at the 3' terminus of the RNA.

In embodiments, the 3'-terminal nucleotide (that is the last 3'-terminal nucleotide in the polynucleotide chain) is the 3'-terminal A nucleotide of the at least one poly(A) sequence. The term "directly located at the 3' terminus" has to be understood as being located exactly at the 3' terminus—in other words, the 3' terminus of the nucleic acid consists of a poly(A) sequence terminating with an A nucleotide.

It has been shown by the inventors that this embodiment is particularly beneficial for induction an immune response against SARS-CoV-2. In this context, it was shown that already one vaccination was sufficient to result in virus-neutralizing antibody titers.

In embodiments, the RNA sequence comprises a poly(A) sequence of at least 70 adenosine nucleotides, wherein the 3'-terminal nucleotide is an adenosine nucleotide.

In this context it has been shown that ending on an adenosine nucleotide decreases the induction of IFNalpha by the RNA vaccine. This is particularly important as the induction of IFNalpha is thought to be the main factor for induction of fever in vaccinated subjects, which of course has to be avoided.

In embodiments, the poly(A) sequence of the RNA is obtained from a DNA template during RNA in vitro transcription. In other embodiments, the poly(A) sequence is obtained in vitro by common methods of chemical synthesis without being necessarily transcribed from a DNA template. In other embodiments, poly(A) sequences are generated by enzymatic polyadenylation of the RNA (after RNA in vitro transcription) using commercially available polyadenylation kits and corresponding protocols known in the art, or alternatively, by using immobilized poly(A)polymerases e.g. using a methods and means as described in WO2016/174271, the entire contents of which are hereby incorporated by reference.

In some embodiments, the RNA comprises a poly(A) sequence obtained by enzymatic polyadenylation, wherein the majority of RNA molecules comprise about 100 (+/−20) to about 500 (+/−50), preferably about 250 (+/−20) adenosine nucleotides.

In other embodiments, the RNA comprises a poly(A) sequence derived from a template DNA and at least one additional poly(A) sequence generated by enzymatic polyadenylation, e.g. as described in WO2016/091391, the entire contents of which are hereby incorporated by reference.

In further embodiments, the RNA comprises at least one poly(C) sequence.

The term "poly(C) sequence" as used herein is intended to be a sequence of cytosine nucleotides of up to about 200 cytosine nucleotides. In preferred embodiments, the poly(C) sequence comprises about 10 to about 200 cytosine nucleotides, about 10 to about 100 cytosine nucleotides, about 20 to about 70 cytosine nucleotides, about 20 to about 60 cytosine nucleotides, or about 10 to about 40 cytosine nucleotides. In a particularly preferred embodiment, the poly(C) sequence comprises about 30 cytosine nucleotides.

In embodiments, the RNA of the invention comprises at least one histone stem-loop (hSL).

The term "histone stem-loop" (abbreviated as "hSL" in e.g. the sequence listing) is intended to refer to a nucleic acid sequences that form a stem-loop secondary structure predominantly found in histone mRNAs.

Histone stem-loop sequences/structures may suitably be selected from histone stem-loop sequences as disclosed in WO2012/019780, the entire contents of which are hereby incorporated by reference, the disclosure relating to histone stem-loop sequences/histone stem-loop structures incorporated herewith by reference. A histone stem-loop sequence that may be used within the present invention may preferably be derived from formulae (I) or (II) of WO2012/019780. According to a further preferred embodiment, the RNA comprises at least one histone stem-loop sequence derived from at least one of the specific formulae (Ia) or (IIa) of the patent application WO2012/019780.

In preferred embodiments, the RNA of the invention comprises at least one histone stem-loop, wherein said histone stem-loop (hSL) comprises or consists of a nucleic acid sequence identical or at least 70%, 80%, 90%, 91%, 92%, 93%, 94%, 95%, 96%, 97%, 98%, or 99% identical to SEQ ID NOs: 37 or 38, or fragments or variants thereof.

In other embodiments, the RNA does not comprise a histone stem-loop as defined herein.

In various embodiments, the RNA comprises a 3'-terminal sequence element. Said 3'-terminal sequence element comprises a poly(A) sequence and optionally a histone-stem-loop sequence. Accordingly, the RNA of the invention comprises at least one 3'-terminal sequence element comprising or consisting of a nucleic acid sequence being identical or at least 70%, 80%, 90%, 91%, 92%, 93%, 94%, 95%, 96%, 97%, 98%, or 99% identical to SEQ ID NOs: 39-44 or a fragment or variant thereof.

In embodiments, the RNA comprises a 3'-terminal sequence element. Said 3'-terminal sequence element comprises a poly(A) sequence. Accordingly, the nucleic acid of the invention comprises at least one 3'-terminal sequence element comprising or consisting of a nucleic acid sequence being identical or at least 70%, 80%, 90%, 91%, 92%, 93%, 94%, 95%, 96%, 97%, 98%, or 99% identical to SEQ ID NOs: 254, 22903, 26999, 28531, 28525, 28539 of WO2022/137133 or a fragment or variant thereof.

In embodiments, the RNA comprises a 3'-terminal sequence element. Said 3'-terminal sequence element comprises a poly(A) sequence and a histone-stem-loop sequence. Accordingly, the nucleic acid of the invention comprises at least one 3'-terminal sequence element comprising or consisting of a nucleic acid sequence being identical or at least 70%, 80%, 90%, 91%, 92%, 93%, 94%, 95%, 96%, 97%, 98%, or 99% identical to SEQ ID NOs: 254, 22893, 26997, 28529, 28533, 28537 of WO2022/137133 or a fragment or variant thereof.

In various embodiments, the RNA may comprise a 5'-terminal sequence element according to SEQ ID NOs: 176, 177 or 22840-22844 of WO2022/137133, or a fragment or variant thereof.

In further embodiments, the RNA may comprise a 5'-terminal sequence element according to SEQ ID NOs: 176, 177 or 22840-22844 of WO2022/137133 or a fragment or variant thereof. Such a 5-terminal sequence element comprises e.g. a binding site for T7 RNA polymerase. Further, the first nucleotide of said 5'-terminal start sequence may preferably comprise a 2'O methylation, e.g. 2'O methylated guanosine or a 2'O methylated adenosine.

In preferred embodiments, the comprises at least one heterologous 5'-UTR that comprises or consists of a nucleic acid sequence derived from a 5'-UTR from HSD17B4 and at least one heterologous 3'-UTR comprises or consists of a nucleic acid sequence derived from a 3'-UTR of PSMB3. In certain embodiments, the 5'-UTR from HSD17B4 is at least about 95%, 96%, 97%, 98% to 99% identical to to SEQ ID NO: 4. In some embodiments, the 3'-UTR of PSMB3 is at least about 95%, 96%, 97%, 98% to 99% identical to to SEQ ID NO: 20. In preferred embodiments the RNA comprises, from 5' to 3': i) 5'-cap1 structure; ii) 5'-UTR derived from a 5'-UTR of a HSD17B4 gene, preferably according to SEQ ID NO: 4; iii) the at least one coding sequence (encoding a SARS-CoV Spike antigen of the embodiments); iv) 3'-UTR derived from a 3'-UTR of a PSMB3 gene, preferably according to SEQ ID NO: 20; v) optionally, a histone stem-loop sequence; and vi) poly(A) sequence comprising about 100 A nucleotides, wherein the 3' terminal nucleotide of said RNA is an adenosine.

In embodiments, the RNA comprises about 50 to about 20000 nucleotides, or about 500 to about 10000 nucleotides, or about 1000 to about 10000 nucleotides, or preferably about 1000 to about 5000 nucleotides, or even more preferably about 2000 to about 5000 nucleotides.

In embodiments, the RNA is a coding RNA. In embodiments, the coding RNA may be selected from an mRNA, a (coding) self-replicating RNA, a (coding) circular RNA, a (coding) viral RNA, or a (coding) replicon RNA.

In other embodiments, the coding RNA is a circular RNA. As used herein, "circular RNAs" and "circRNAs" have to be understood as circular polynucleotide constructs that encode at least one antigenic peptide or protein as defined herein. In embodiments, such a circRNA is a single stranded RNA molecule. In embodiments, said circRNA comprises at least one coding sequence encoding at least one antigenic protein from a SARS-CoV-2 coronavirus, or an immunogenic fragment or an immunogenic variant thereof.

In further embodiments, the coding RNA is a replicon RNA. The term "replicon RNA" will be recognized and understood by the person of ordinary skill in the art, and is e.g. intended to be an optimized self-replicating RNA. Such constructs may include replicase elements derived from e.g. alphaviruses (e.g. SFV, SIN, VEE, or RRV) and the substitution of the structural virus proteins with the nucleic acid of interest (that is, the coding sequence encoding an antigenic peptide or protein of a SARS-CoV-2 coronavirus). Alternatively, the replicase may be provided on an independent coding RNA construct or a coding DNA construct. Downstream of the replicase may be a sub-genomic promoter that controls replication of the replicon RNA.

In embodiments, the at least one nucleic acid is not a replicon RNA or a self-replicating RNA.

In preferred embodiments, the RNA of the invention is an mRNA.

In embodiments, the mRNA does not comprise a replicase element (e.g. a nucleic acid encoding a replicase).

The terms "RNA" and "mRNA" will be recognized and understood by the person of ordinary skill in the art, and are e.g. intended to be a ribonucleic acid molecule, i.e. a polymer consisting of nucleotides. These nucleotides are usually adenosine-monophosphate, uridine-monophosphate, guanosine-monophosphate and cytidine-monophosphate monomers which are connected to each other along a so-called backbone. The backbone is formed by phosphodiester bonds between the sugar, i.e. ribose, of a first and a phosphate moiety of a second, adjacent monomer. The specific succession of the monomers is called the RNA-sequence. The mRNA (messenger RNA) provides the nucleotide coding sequence that may be translated into an amino-acid sequence of a particular peptide or protein.

In the context of the invention, the RNA or the mRNA, provides at least one coding sequence encoding an antigenic protein from a SARS-CoV-2 spike protein as defined herein that is translated into a (functional) antigen after administration (e.g. after administration to a subject, e.g. a human subject).

In preferred embodiments, the RNA, preferably the mRNA is suitable for a SARS-CoV-2 vaccine, preferably a SARS-CoV-2 vaccine against at least one of the following SARS-CoV-2 isolates: B.1.1.529 (Omicron), BA.1 (Omicron), BA.2 (Omicron), BA.4 (Omicron), BA.5 (Omicron), B.1.1.7 (Alpha), B.1.351 (Beta), P.1 (Gamma), B.1.617.2 (Delta), C.37 (Lambda), BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44.

In preferred embodiments, the RNA, the mRNA is suitable for a SARS-CoV-2 vaccine, preferably a SARS-CoV-2 vaccine against BA.4 (Omicron), BA.5 (Omicron), BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44.

Suitably, the RNA may be modified by the addition of a 5'-cap structure, which preferably stabilizes the RNA and/or enhances expression of the encoded antigen and/or reduces the stimulation of the innate immune system (after administration to a subject). A 5'-cap structure is of particular importance in embodiments where the RNA is a linear coding RNA, e.g. a linear mRNA or a linear coding replicon RNA.

Accordingly, in preferred embodiments, the RNA, in particular the mRNA comprises a 5'-cap structure, preferably cap0, cap1, cap2, a modified cap0, or a modified cap1 structure.

The term "5'-cap structure" as used herein will be recognized and understood by the person of ordinary skill in the art, and is e.g. intended to refer to a 5' modified nucleotide, particularly a guanine nucleotide, positioned at the 5'-end of an RNA, e.g. an mRNA. In embodiments, the 5'-cap structure is connected via a 5'-5'-triphosphate linkage to the RNA. 5'-cap structures which may be suitable in the context of the present invention are cap0 (methylation of the first nucleobase, e.g. m7GpppN), cap1 (additional methylation of the ribose of the adjacent nucleotide of m7GpppN), cap2 (additional methylation of the ribose of the 2nd nucleotide downstream of the m7GpppN), cap3 (additional methylation of the ribose of the 3rd nucleotide downstream of the m7GpppN), cap4 (additional methylation of the ribose of the 4th nucleotide downstream of the m7GpppN), ARCA (anti-reverse cap analogue), modified ARCA (e.g. phosphothioate modified ARCA), inosine, N1-methyl-guanosine, 2'-fluoro-guanosine, 7-deaza-guanosine, 8-oxo-guanosine, 2-amino-guanosine, LNA-guanosine, and 2-azido-guanosine.

A 5'-cap (cap0 or cap1) structure may be formed in chemical RNA synthesis or in RNA in vitro transcription (co-transcriptional capping) using cap analogues.

The term "cap analogue" as used herein will be recognized and understood by the person of ordinary skill in the art, and is e.g. intended to refer to a non-polymerizable di-nucleotide or tri-nucleotide that has cap functionality in that it facilitates translation or localization, and/or prevents degradation of a nucleic acid molecule, particularly of an RNA molecule, when incorporated at the 5'-end of the nucleic acid molecule. Non-polymerizable means that the cap analogue will be incorporated only at the 5'-terminus because it does not have a 5' triphosphate and therefore cannot be extended in the 3'-direction by a template-dependent polymerase, particularly, by template-dependent RNA polymerase. Examples of cap analogues include, but are not limited to, a chemical structure selected from the group consisting of m7GpppG, m7GpppA, m7GpppC; unmethylated cap analogues (e.g. GpppG); dimethylated cap analogue (e.g. m2,7GpppG), trimethylated cap analogue (e.g. m2,2,7GpppG), dimethylated symmetrical cap analogues (e.g. m7Gpppm7G), or anti reverse cap analogues (e.g. ARCA; m7,2'OmeGpppG, m7,2'dGpppG, m7,3'OmeGpppG, m7,3'dGpppG and their tetraphosphate derivatives). Further cap analogues have been described previously (WO2008/016473, WO2008/157688, WO2009/149253, WO2011/015347, and WO2013/059475). Further suitable cap analogues in that context are described in WO2017/066793, WO2017/066781, WO2017/066791, WO2017/066789, WO2017/053297, WO2017/066782, WO2018/075827 and WO2017/066797 wherein the disclosures referring to cap analogues are incorporated herewith by reference.

In some embodiments, a modified cap1 structure is generated using tri-nucleotide cap analogue as disclosed in WO2017/053297, WO2017/066793, WO2017/066781, WO2017/066791, WO2017/066789, WO2017/066782, WO2018/075827 and WO2017/066797, the entire contents of the aforementioned PCT applications are hereby incorporated by reference. Any cap structures derivable from the structure disclosed in claim 1-5 of WO2017/053297 may be suitably used to co-transcriptionally generate a modified cap1 structure. Further, any cap structures derivable from the structure defined in claim 1 or claim 21 of WO2018/075827 may be suitably used to co-transcriptionally generate a modified cap1 structure.

In preferred embodiments, the RNA, in particular the mRNA comprises a cap1 structure.

In embodiments, the 5'-cap structure may suitably be added co-transcriptionally using tri-nucleotide cap analogue as defined herein in an RNA in vitro transcription reaction as defined herein.

In embodiments, the cap1 structure of the coding RNA of the invention is formed using co-transcriptional capping using tri-nucleotide cap analogues m7G(5')ppp(5')(2'OMeA)pG or m7G(5')ppp(5')(2'OMeG)pG. A preferred cap1 analogues in that context is m7G(5')ppp(5')(2'OMeA)pG.

In other embodiments, the cap1 structure of the RNA of the invention is formed using co-transcriptional capping using tri-nucleotide cap analogue 3'OMe-m7G(5')ppp(5')(2'OMeA)pG.

In other embodiments, a cap0 structure of the RNA of the invention is formed using co-transcriptional capping using cap analogue 3'OMe-m7G(5')ppp(5')G.

In other embodiments, the 5'-cap structure is formed via enzymatic capping using capping enzymes (e.g. vaccinia virus capping enzymes and/or cap-dependent 2'-O methyltransferases) to generate cap0 or cap1 or cap2 structures.

The 5'-cap structure (cap0 or cap1) may be added using immobilized capping enzymes and/or cap-dependent 2'-O methyltransferases using methods and means disclosed in WO2016/193226, the entire content of which is hereby incorporated by reference.

In embodiments, about 70%, 75%, 80%, 85%, 90%, 95% of the RNA (species) comprises a cap1 structure as determined using a capping assay. In preferred embodiments, less than about 20%, 15%, 10%, 5%, 4%, 3%, 2%, 1% of the RNA (species) does not comprise a cap1 structure as determined using a capping assay. In other embodiments, about 70%, 75%, 80%, 85%, 90%, 95% of the RNA (species) comprises a cap0 structure as determined using a capping assay. In preferred embodiments, less than about 20%, 15%, 10%, 5%, 4%, 3%, 2%, 1% of the RNA (species) does not comprise a cap0 structure as determined using a capping assay.

The term "RNA species" is not restricted to mean "one single molecule" but is understood to comprise an ensemble of essentially identical RNA molecules. Accordingly, it may relate to a plurality of essentially identical (coding) RNA molecules.

For determining the presence/absence of a cap0 or a cap1 structure, a capping assay as described in published PCT application WO2015/101416, the entire content of which is hereby incorporated by reference; in particular, as described in claims 27 to 46 of published PCT application WO2015/101416 can be used. Other capping assays that may be used to determine the presence/absence of a cap0 or a cap1 structure of an RNA are described in PCT/EP2018/08667, or published PCT applications WO2014/152673 and WO2014/152659, the entire content of the aforementioned PCT applications are hereby incorporated by reference.

In preferred embodiments, the RNA comprises an m7G(5')ppp(5')(2'OMeA) cap structure. In such embodiments, the coding RNA comprises a 5'-terminal m7G cap, and an additional methylation of the ribose of the adjacent nucleotide of m7GpppN, in that case, a 2'O methylated Adenosine. Preferably, about 70%, 75%, 80%, 85%, 90%, 95% of the RNA (species) comprises such a cap1 structure as determined using a capping assay.

In other embodiments, the RNA comprises an m7G(5')ppp(5')(2'OMeG) cap structure. In such embodiments, the coding RNA comprises a 5'-terminal m7G cap, and an additional methylation of the ribose of the adjacent nucleotide, in that case, a 2'O methylated guanosine. Preferably, about 70%, 75%, 80%, 85%, 90%, 95% of the coding RNA (species) comprises such a cap1 structure as determined using a capping assay.

Accordingly, the first nucleotide of said RNA or mRNA sequence, that is, the nucleotide downstream of the m7G(5')ppp structure, may be a 2'O methylated guanosine or a 2'O methylated adenosine.

According to some embodiments, the RNA is a modified RNA, wherein the modification refers to chemical modifications comprising backbone modifications as well as sugar modifications or base modifications.

A modified RNA may comprise nucleotide analogues/modifications, e.g. backbone modifications, sugar modifications or base modifications. A backbone modification in the context of the invention is a modification, in which phosphates of the backbone of the nucleotides of the RNA are chemically modified. A sugar modification in the context of the invention is a chemical modification of the sugar of the nucleotides of the RNA. Furthermore, a base modification in the context of the invention is a chemical modification of the base moiety of the nucleotides of the RNA. In this context, nucleotide analogues or modifications are preferably selected from nucleotide analogues which are applicable for transcription and/or translation.

In embodiments, the nucleotide analogues/modifications which may be incorporated into a modified RNA as described herein are selected from 2-amino-6-chloropurineriboside-5'-triphosphate, 2-Aminopurine-riboside-5'-triphosphate; 2-aminoadenosine-5'-triphosphate, 2'-Amino-2'-deoxycytidine-triphosphate, 2-thiocytidine-5'-triphosphate, 2-thiouridine-5'-triphosphate, 2'-Fluorothymidine-5'-triphosphate, 2'-O-Methyl-inosine-5'-triphosphate 4-thiouridine-5'-triphosphate, 5-aminoallylcytidine-5'-triphosphate, 5-aminoallyluridine-5'-triphosphate, 5-bromocytidine-5'-triphosphate, 5-bromouridine-5'-triphosphate, 5-Bromo-2'-deoxycytidine-5'-triphosphate, 5-Bromo-2'-deoxyuridine-5'-triphosphate, 5-iodocytidine-5'-triphosphate, 5-Iodo-2'-deoxycytidine-5'-triphosphate, 5-iodouridine-5'-triphosphate, 5-Iodo-2'-deoxyuridine-5'-triphosphate, 5-methylcytidine-5'-triphosphate, 5-methyluridine-5'-triphosphate, 5-Propynyl-2'-deoxycytidine-5'-triphosphate, 5-Propynyl-2'-deoxyuridine-5'-triphosphate, 6-azacytidine-5'-triphosphate, 6-azauridine-5'-triphosphate, 6-chloropurineriboside-5'-triphosphate, 7-deazaadenosine-5'-triphosphate, 7-deazaguanosine-5'-triphosphate, 8-azaadenosine-5'-triphosphate, 8-azidoadenosine-5'-triphosphate, benzimidazole-riboside-5'-triphosphate, N1-methyladenosine-5'-triphosphate, N1-methylguanosine-5'-triphosphate, N6-methyladenosine-5'-triphosphate, O6-methylguanosine-5'-triphosphate, pseudouridine-5'-triphosphate, or puromycin-5'-triphosphate, xanthosine-5'-triphosphate In embodiments, the nucleotides for base modifications are selected from the group of base-modified nucleotides consisting of 5-methylcytidine-5'-triphosphate, 7-deazaguanosine-5'-triphosphate, 5-bromocytidine-5'-triphosphate, and pseudouridine-5'-triphosphate, pyridin-4-one ribonucleoside, 5-azauridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine, 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine, 2-aminopurine, 2, 6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyl-adenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine, inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methylinosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine, 5'-O-(1-thiophosphate)-adenosine, 5'-O-(1-thiophosphate)-cytidine, 5'-O-(1-thiophosphate)-guanosine, 5'-O-(1-thiophosphate)-uridine, 5'-O-(1-thiophosphate)-pseudouridine, 6-aza-cytidine, 2-thio-cytidine, alpha-thio-cytidine, Pseudo-iso-cytidine, 5-aminoallyl-uridine, 5-iodo-uridine, N1-methyl-pseudouridine, 5,6-dihydrouridine, alpha-thio-uridine, 4-thio-uridine, 6-aza-uridine, 5-hydroxy-uridine, deoxy-thymidine, 5-methyl-uridine, Pyrrolo-cytidine, inosine, alpha-thio-guanosine, 6-methyl-guanosine, 5-methyl-cytidine, 8-oxo-guanosine, 7-deaza-guanosine, N1-methyl-adenosine, 2-amino-6-Chloro-purine, N6-methyl-2-amino-purine, Pseudo-iso-cytidine, 6-Chloro-purine, N6-methyl-adenosine, alpha-thio-adenosine, 8-azido-adenosine, and 7-deaza-adenosine.

In some embodiments, the at least one modified nucleotide is selected from pseudouridine, N1-methylpseudouridine, N1-ethylpseudouridine, 2-thiouridine, 4'-thiouridine, 5-methylcytosine, 5-methyluridine, 2-thio-1-methyl-1-deaza-pseudouridine, 2-thio-1-methyl-pseudouridine, 2-thio-5-aza-uridine, 2-thio-dihydropseudouridine, 2-thio-dihydrouridine, 2-thio-pseudouridine, 4-methoxy-2-thio-pseudouridine, 4-methoxy-pseudouridine, 4-thio-1-methyl-pseudouridine, 4-thio-pseudouridine, 5-aza-uridine, dihydropseudouridine, 5-methoxyuridine and 2'-O-methyl uridine.

In some embodiments, 100% of the uracil in the coding sequence as defined herein have a chemical modification, preferably a chemical modification is in the 5-position of the uracil.

Preferred in the context of the invention are pseudouridine (ψ), N1-methylpseudouridine (m1ψ), 5-methylcytosine, and 5-methoxyuridine.

Particularly preferred in the context of the invention is N1-methylpseudouridine (m1ψ; referred as tp m1f in the sequence listing).

In some embodiments, however, the RNA of the invention does not include any N1-methylpseudouridine (m1ψ) substituted positions. In further aspects, the RNA of the embodiments does not include any pseudouridine (ψ), N1-methylpseudouridine (m1ψ), 5-methylcytosine, and 5-methoxyuridine substituted position. In still further embodiments, the RNA of the invention comprises a coding sequence that consists only of G, C, A and U nucleotides.

Incorporating modified nucleotides such as pseudouridine (ψ), N1-methylpseudouridine (m1ψ), 5-methylcytosine, and/or 5-methoxyuridine into the coding sequence of the RNA may be advantageous as unwanted innate immune responses (upon administration of the coding RNA or the vaccine) may be adjusted or reduced (if required).

In some embodiments, the RNA comprises at least one coding sequence encoding a SARS-CoV-2 antigenic protein as defined herein, wherein said coding sequence comprises at least one modified nucleotide selected from pseudouridine (ψ) and N1-methylpseudouridine (m1ψ), preferably wherein all uracil nucleotides are replaced by pseudouridine (ψ) nucleotides and/or N1-methylpseudouridine (m1ψ) nucleotides.

In embodiments, the RNA does not comprise N1-methylpseudouridine (m1ψ) substituted positions. In further embodiments, the RNA does not comprise pseudouridine (ψ), N1-methylpseudouridine (m1ψ), 5-methylcytosine, and 5-methoxyuridine substituted position.

In embodiments, the RNA comprises a coding sequence that consists only of G, C, A and U nucleotides and therefore does not comprise modified nucleotides (except of the 5' terminal cap structure, e.g. cap1)

mRNA Constructs Suitable for a Coronavirus Vaccine:

In various embodiments the RNA or the mRNA comprises, preferably in 5'- to 3'-direction, the following elements:

A) 5'-cap structure as specified herein;
B) 5-terminal start element as specified herein;
C) optionally, a 5'-UTR, as specified herein;
D) a ribosome binding site, as specified herein;
E) at least one coding sequence, as specified herein;
F) 3'-UTR, as specified herein;
G) optionally, poly(A) sequence, as specified herein;
H) optionally, poly(C) sequence, as specified herein;
I) optionally, histone stem-loop as specified herein;
J) optionally, 3'-terminal sequence element, as specified herein.

In preferred embodiments the nucleic acid or the mRNA, comprises the following elements in 5'- to 3'-direction:

A) cap1 structure as defined herein;
B) 5'-UTR derived from a HSD17B4 gene as defined herein, according to SEQ ID NOs: 3 or 4;
C) coding sequence selected from SEQ ID NOs: 70-80, 165-170, 202-220, 259-263, 277-289 or fragments or variants thereof;
D) 3'-UTR derived from a 3'-UTR of a PSMB3 gene as defined herein, according to SEQ ID NOs: 19 or 20;
E) a histone stem-loop selected from SEQ ID NOs: 37 or 38;
F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NOs: 70-80, 165-170, 202-220, 259-263, 277-289 or fragments or variants thereof;
- D) 3'-UTR derived from a 3'-UTR of a PSMB3 gene as defined herein, according to SEQ ID NOs: 19 or 20;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NOs: 70-80, 165-170, 202-220, 259-263, 277-289 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NO: 70 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NO: 71 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NO: 72 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NO: 73 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NO: 74 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NO: 75 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NO: 76 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;

C) coding sequence selected from SEQ ID NO: 77 or fragments or variants thereof;
D) 3'-UTR derived from a 3'-UTR of a PSMB3 gene as defined herein, according to SEQ ID NOs: 19 or 20;
E) a histone stem-loop selected from SEQ ID NOs: 37 or 38;
F) poly(A) sequence comprising about 100 A nucleotides, representing the 3' terminus.

In further preferred embodiments the nucleic acid or the mRNA, comprises the following elements in 5'- to 3'-direction:
A) cap1 structure as defined herein;
B) 5'-UTR derived from a HSD17B4 gene as defined herein, according to SEQ ID NOs: 3 or 4;
C) coding sequence selected from SEQ ID NO: 78 or fragments or variants thereof;
D) 3'-UTR derived from a 3'-UTR of a PSMB3 gene as defined herein, according to SEQ ID NOs: 19 or 20;
E) a histone stem-loop selected from SEQ ID NOs: 37 or 38;
F) poly(A) sequence comprising about 100 A nucleotides, representing the 3' terminus.

In further preferred embodiments the nucleic acid or the mRNA, comprises the following elements in 5'- to 3'-direction:
A) cap1 structure as defined herein;
B) 5'-UTR derived from a HSD17B4 gene as defined herein, according to SEQ ID NOs: 3 or 4;
C) coding sequence selected from SEQ ID NO: 79 or fragments or variants thereof;
D) 3'-UTR derived from a 3'-UTR of a PSMB3 gene as defined herein, according to SEQ ID NOs: 19 or 20;
E) a histone stem-loop selected from SEQ ID NOs: 37 or 38;
F) poly(A) sequence comprising about 100 A nucleotides, representing the 3' terminus.

In further preferred embodiments the nucleic acid or the mRNA, comprises the following elements in 5'- to 3'-direction:
A) cap1 structure as defined herein;
B) 5'-UTR derived from a HSD17B4 gene as defined herein, according to SEQ ID NOs: 3 or 4;
C) coding sequence selected from SEQ ID NOs: 80 or fragments or variants thereof;
D) 3'-UTR derived from a 3'-UTR of a PSMB3 gene as defined herein, according to SEQ ID NOs: 19 or 20;
E) a histone stem-loop selected from SEQ ID NOs: 37 or 38;
F) poly(A) sequence comprising about 100 A nucleotides, representing the 3' terminus.

In further preferred embodiments the nucleic acid or the mRNA, comprises the following elements in 5'- to 3'-direction:
A) cap1 structure as defined herein;
B) 5'-UTR derived from a HSD17B4 gene as defined herein, according to SEQ ID NOs: 3 or 4;
C) coding sequence selected from SEQ ID NO: 165 or fragments or variants thereof;
D) 3'-UTR derived from a 3'-UTR of a PSMB3 gene as defined herein, according to SEQ ID NOs: 19 or 20;
E) a histone stem-loop selected from SEQ ID NOs: 37 or 38;
F) poly(A) sequence comprising about 100 A nucleotides, representing the 3' terminus.

In further preferred embodiments the nucleic acid or the mRNA, comprises the following elements in 5'- to 3'-direction:
A) cap1 structure as defined herein;
B) 5'-UTR derived from a HSD17B4 gene as defined herein, according to SEQ ID NOs: 3 or 4;
C) coding sequence selected from SEQ ID NO: 166 or fragments or variants thereof;
D) 3'-UTR derived from a 3'-UTR of a PSMB3 gene as defined herein, according to SEQ ID NOs: 19 or 20;
E) a histone stem-loop selected from SEQ ID NOs: 37 or 38;
F) poly(A) sequence comprising about 100 A nucleotides, representing the 3' terminus.

In further preferred embodiments the nucleic acid or the mRNA, comprises the following elements in 5'- to 3'-direction:
A) cap1 structure as defined herein;
B) 5'-UTR derived from a HSD17B4 gene as defined herein, according to SEQ ID NOs: 3 or 4;
C) coding sequence selected from SEQ ID NO: 167 or fragments or variants thereof;
D) 3'-UTR derived from a 3'-UTR of a PSMB3 gene as defined herein, according to SEQ ID NOs: 19 or 20;
E) a histone stem-loop selected from SEQ ID NOs: 37 or 38;
F) poly(A) sequence comprising about 100 A nucleotides, representing the 3' terminus.

In particularly preferred embodiments the nucleic acid or the mRNA, comprises the following elements in 5'- to 3'-direction:
A) cap1 structure as defined herein;
B) 5'-UTR derived from a HSD17B4 gene as defined herein, according to SEQ ID NOs: 3 or 4;
C) coding sequence selected from SEQ ID NO: 168 or fragments or variants thereof;
D) 3'-UTR derived from a 3'-UTR of a PSMB3 gene as defined herein, according to SEQ ID NOs: 19 or 20;
E) a histone stem-loop selected from SEQ ID NOs: 37 or 38;
F) poly(A) sequence comprising about 100 A nucleotides, representing the 3' terminus.

In further preferred embodiments the nucleic acid or the mRNA, comprises the following elements in 5'- to 3'-direction:
A) cap1 structure as defined herein;
B) 5'-UTR derived from a HSD17B4 gene as defined herein, according to SEQ ID NOs: 3 or 4;
C) coding sequence selected from SEQ ID NO: 169 or fragments or variants thereof;
D) 3'-UTR derived from a 3'-UTR of a PSMB3 gene as defined herein, according to SEQ ID NOs: 19 or 20;
E) a histone stem-loop selected from SEQ ID NOs: 37 or 38;
F) poly(A) sequence comprising about 100 A nucleotides, representing the 3' terminus.

In further preferred embodiments the nucleic acid or the mRNA, comprises the following elements in 5'- to 3'-direction:
A) cap1 structure as defined herein;
B) 5'-UTR derived from a HSD17B4 gene as defined herein, according to SEQ ID NOs: 3 or 4;
C) coding sequence selected from SEQ ID NOs: 170 or fragments or variants thereof;
D) 3'-UTR derived from a 3'-UTR of a PSMB3 gene as defined herein, according to SEQ ID NOs: 19 or 20;
E) a histone stem-loop selected from SEQ ID NOs: 37 or 38;
F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NO: 202 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NO: 203 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NO: 204 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NO: 205 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NO: 206 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NO: 207 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NO: 208 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NO: 209 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NO: 210 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;

C) coding sequence selected from SEQ ID NO: 211 or fragments or variants thereof;
D) 3'-UTR derived from a 3'-UTR of a PSMB3 gene as defined herein, according to SEQ ID NOs: 19 or 20;
E) a histone stem-loop selected from SEQ ID NOs: 37 or 38;
F) poly(A) sequence comprising about 100 A nucleotides, representing the 3' terminus.

In further preferred embodiments the nucleic acid or the mRNA, comprises the following elements in 5'- to 3'-direction:
A) cap1 structure as defined herein;
B) 5'-UTR derived from a HSD17B4 gene as defined herein, according to SEQ ID NOs: 3 or 4;
C) coding sequence selected from SEQ ID NO: 212 or fragments or variants thereof;
D) 3'-UTR derived from a 3'-UTR of a PSMB3 gene as defined herein, according to SEQ ID NOs: 19 or 20;
E) a histone stem-loop selected from SEQ ID NOs: 37 or 38;
F) poly(A) sequence comprising about 100 A nucleotides, representing the 3' terminus.

In further preferred embodiments the nucleic acid or the mRNA, comprises the following elements in 5'- to 3'-direction:
A) cap1 structure as defined herein;
B) 5'-UTR derived from a HSD17B4 gene as defined herein, according to SEQ ID NOs: 3 or 4;
C) coding sequence selected from SEQ ID NO: 213 or fragments or variants thereof;
D) 3'-UTR derived from a 3'-UTR of a PSMB3 gene as defined herein, according to SEQ ID NOs: 19 or 20;
E) a histone stem-loop selected from SEQ ID NOs: 37 or 38;
F) poly(A) sequence comprising about 100 A nucleotides, representing the 3' terminus.

In further preferred embodiments the nucleic acid or the mRNA, comprises the following elements in 5'- to 3'-direction:
A) cap1 structure as defined herein;
B) 5'-UTR derived from a HSD17B4 gene as defined herein, according to SEQ ID NOs: 3 or 4;
C) coding sequence selected from SEQ ID NO: 214 or fragments or variants thereof;
D) 3'-UTR derived from a 3'-UTR of a PSMB3 gene as defined herein, according to SEQ ID NOs: 19 or 20;
E) a histone stem-loop selected from SEQ ID NOs: 37 or 38;
F) poly(A) sequence comprising about 100 A nucleotides, representing the 3' terminus.

In further preferred embodiments the nucleic acid or the mRNA, comprises the following elements in 5'- to 3'-direction:
A) cap1 structure as defined herein;
B) 5'-UTR derived from a HSD17B4 gene as defined herein, according to SEQ ID NOs: 3 or 4;
C) coding sequence selected from SEQ ID NO: 215 or fragments or variants thereof;
D) 3'-UTR derived from a 3'-UTR of a PSMB3 gene as defined herein, according to SEQ ID NOs: 19 or 20;
E) a histone stem-loop selected from SEQ ID NOs: 37 or 38;
F) poly(A) sequence comprising about 100 A nucleotides, representing the 3' terminus.

In further preferred embodiments the nucleic acid or the mRNA, comprises the following elements in 5'- to 3'-direction:
A) cap1 structure as defined herein;
B) 5'-UTR derived from a HSD17B4 gene as defined herein, according to SEQ ID NOs: 3 or 4;
C) coding sequence selected from SEQ ID NO: 216 or fragments or variants thereof;
D) 3'-UTR derived from a 3'-UTR of a PSMB3 gene as defined herein, according to SEQ ID NOs: 19 or 20;
E) a histone stem-loop selected from SEQ ID NOs: 37 or 38;
F) poly(A) sequence comprising about 100 A nucleotides, representing the 3' terminus.

In further preferred embodiments the nucleic acid or the mRNA, comprises the following elements in 5'- to 3'-direction:
A) cap1 structure as defined herein;
B) 5'-UTR derived from a HSD17B4 gene as defined herein, according to SEQ ID NOs: 3 or 4;
C) coding sequence selected from SEQ ID NO: 217 or fragments or variants thereof;
D) 3'-UTR derived from a 3'-UTR of a PSMB3 gene as defined herein according to SEQ ID NOs: 19 or 20;
E) a histone stem-loop selected from SEQ ID NOs: 37 or 38;
F) poly(A) sequence comprising about 100 A nucleotides, representing the 3' terminus.

In further preferred embodiments the nucleic acid or the mRNA, comprises the following elements in 5'- to 3'-direction:
A) cap1 structure as defined herein;
B) 5'-UTR derived from a HSD17B4 gene as defined herein, according to SEQ ID NOs: 3 or 4;
C) coding sequence selected from SEQ ID NO: 218 or fragments or variants thereof;
D) 3'-UTR derived from a 3'-UTR of a PSMB3 gene as defined herein, according to SEQ ID NOs: 19 or 20;
E) a histone stem-loop selected from SEQ ID NOs: 37 or 38;
F) poly(A) sequence comprising about 100 A nucleotides, representing the 3' terminus.

In further preferred embodiments the nucleic acid or the mRNA, comprises the following elements in 5'- to 3'-direction:
A) cap1 structure as defined herein;
B) 5'-UTR derived from a HSD17B4 gene as defined herein, according to SEQ ID NOs: 3 or 4;
C) coding sequence selected from SEQ ID NO: 219 or fragments or variants thereof;
D) 3'-UTR derived from a 3'-UTR of a PSMB3 gene as defined herein, according to SEQ ID NOs: 19 or 20;
E) a histone stem-loop selected from SEQ ID NOs: 37 or 38;
F) poly(A) sequence comprising about 100 A nucleotides, representing the 3' terminus.

In further preferred embodiments the nucleic acid or the mRNA, comprises the following elements in 5'- to 3'-direction:
A) cap1 structure as defined herein;
B) 5'-UTR derived from a HSD17B4 gene as defined herein, according to SEQ ID NOs: 3 or 4;
C) coding sequence selected from SEQ ID NO: 220 or fragments or variants thereof;
D) 3'-UTR derived from a 3'-UTR of a PSMB3 gene as defined herein, according to SEQ ID NOs: 19 or 20;
E) a histone stem-loop selected from SEQ ID NOs: 37 or 38;
F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NO: 259 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NO: 262 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NO: 277 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NO: 278 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NO: 279 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NO: 280 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NO: 281 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NO: 282 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;
- C) coding sequence selected from SEQ ID NO: 283 or fragments or variants thereof;
- D) 3'-UTR derived from a 3'-UTR of a PSMB3 gene as defined herein, according to SEQ ID NOs: 19 or 20;
- E) a histone stem-loop selected from SEQ ID NOs: 37 or 38;
- F) poly(A) sequence comprising about 100 A nucleotides, representing the 3' terminus.

In further preferred embodiments the nucleic acid or the mRNA, comprises the following elements in 5'- to 3'-direction:
- A) cap1 structure as defined herein;
- B) 5'-UTR derived from a HSD17B4 gene as defined herein, according to SEQ ID NOs: 3 or 4;

C) coding sequence selected from SEQ ID NO: 284 or fragments or variants thereof;
D) 3'-UTR derived from a 3'-UTR of a PSMB3 gene as defined herein, according to SEQ ID NOs: 19 or 20;
E) a histone stem-loop selected from SEQ ID NOs: 37 or 38;
F) poly(A) sequence comprising about 100 A nucleotides, representing the 3' terminus.

In further preferred embodiments the nucleic acid or the mRNA, comprises the following elements in 5'- to 3'-direction:
A) cap1 structure as defined herein;
B) 5'-UTR derived from a HSD17B4 gene as defined herein, according to SEQ ID NOs: 3 or 4;
C) coding sequence selected from SEQ ID NO: 285 or fragments or variants thereof;
D) 3'-UTR derived from a 3'-UTR of a PSMB3 gene as defined herein, according to SEQ ID NOs: 19 or 20;
E) a histone stem-loop selected from SEQ ID NOs: 37 or 38;
F) poly(A) sequence comprising about 100 A nucleotides, representing the 3' terminus.

In further preferred embodiments the nucleic acid or the mRNA, comprises the following elements in 5'- to 3'-direction:
A) cap1 structure as defined herein;
B) 5'-UTR derived from a HSD17B4 gene as defined herein, according to SEQ ID NOs: 3 or 4;
C) coding sequence selected from SEQ ID NO: 286 or fragments or variants thereof;
D) 3'-UTR derived from a 3'-UTR of a PSMB3 gene as defined herein, preferably according to SEQ ID NOs: 19 or 20;
E) a histone stem-loop selected from SEQ ID NOs: 37 or 38;
F) poly(A) sequence comprising about 100 A nucleotides, representing the 3' terminus.

In particularly preferred embodiments the nucleic acid, the mRNA, comprises the following elements in 5'- to 3'-direction:
A) cap1 structure as defined herein;
B) 5'-UTR derived from a HSD17B4 gene as defined herein, according to SEQ ID NOs: 3 or 4;
C) coding sequence selected from SEQ ID NO: 287 or fragments or variants thereof;
D) 3'-UTR derived from a 3'-UTR of a PSMB3 gene as defined herein, according to SEQ ID NOs: 19 or 20;
E) a histone stem-loop selected from SEQ ID NOs: 37 or 38;
F) poly(A) sequence comprising about 100 A nucleotides, representing the 3' terminus.

In further preferred embodiments the nucleic acid or the mRNA, comprises the following elements in 5'- to 3'-direction:
A) cap1 structure as defined herein;
B) 5'-UTR derived from a HSD17B4 gene as defined herein, according to SEQ ID NOs: 3 or 4;
C) coding sequence selected from SEQ ID NO: 288 or fragments or variants thereof;
D) 3'-UTR derived from a 3'-UTR of a PSMB3 gene as defined herein, according to SEQ ID NOs: 19 or 20;
E) a histone stem-loop selected from SEQ ID NOs: 37 or 38;
F) poly(A) sequence comprising about 100 A nucleotides, representing the 3' terminus.

In preferred embodiments the nucleic acid or the mRNA, comprises the following elements in 5'- to 3'-direction:
i) a 5'-cap1 structure;
ii) a 5'-UTR according to SEQ ID NO: 11 or 12;
iii) the at least one coding sequence as defined herein;
iv) a 3'-UTR according to SEQ ID NO: 31 or 32;
v) a poly(A) sequence according to SEQ ID NO: 44, or a nucleotide sequence having at least 99%, 98%, 97%, 96%, 95%, 90%, 85%, or 80% identity to the nucleotide sequence SEQ ID NO: 44.

In preferred embodiments the nucleic acid or the mRNA, comprises the following elements in 5'- to 3'-direction:
i) a 5'-cap1 structure;
ii) a 5'-UTR according to SEQ ID NO: 11 or 12;
iii) coding sequence selected from SEQ ID NO: 259 or fragments or variants thereof;
iv) a 3'-UTR according to SEQ ID NO: 31 or 32;
v) a poly(A) sequence according to SEQ ID NO: 44, or a nucleotide sequence having at least 99%, 98%, 97%, 96%, 95%, 90%, 85%, or 80% identity to the nucleotide sequence SEQ ID NO: 44.

In preferred embodiments the nucleic acid or the mRNA, comprises the following elements in 5'- to 3'-direction:
i) a 5'-cap1 structure;
ii) a 5'-UTR according to SEQ ID NO: 7 or 8;
iii) coding sequence selected from SEQ ID NO: 262 or fragments or variants thereof;
iv) a 3'-UTR according to SEQ ID NO: 23 or 24, or 27 or 28;
v) a poly(A) sequence according to SEQ ID NO: 43, or a nucleotide sequence having at least 99%, 98%, 97%, 96%, 95%, 90%, 85%, or 80% identity to the nucleotide sequence SEQ ID NO: 43.

In preferred embodiments the nucleic acid or the mRNA, comprises the following elements in 5'- to 3'-direction:
i) a 5'-cap1 structure;
ii) a 5'-UTR according to SEQ ID NO: 7-10;
iii) the at least one coding sequence as defined herein;
iv) a 3'-UTR according to SEQ ID NO: 23-30;
v) a poly(A) sequence according to SEQ ID NO: 43, or a nucleotide sequence having at least 99%, 98%, 97%, 96%, 95%, 90%, 85%, or 80% identity to the nucleotide sequence SEQ ID NO: 43.

In preferred embodiments the nucleic acid or the mRNA, comprises the following elements in 5'- to 3'-direction:
i) a 5'-cap1 structure;
ii) a 5'-UTR according to SEQ ID NO: 7-10;
iii) coding sequence selected from SEQ ID NO: 262 or fragments or variants thereof;
iv) a 3'-UTR according to SEQ ID NO: 23-30;
v) a poly(A) sequence according to SEQ ID NO: 43, or a nucleotide sequence having at least 99%, 98%, 97%, 96%, 95%, 90%, 85%, or 80% identity to the nucleotide sequence SEQ ID NO: 43.

Preferred RNA sequences, preferably mRNA sequences of the invention are provided in Table 2. Therein, each row represents a specific suitable SARS-CoV-2 construct of the invention, wherein the description of the SARS-CoV-2 construct is indicated in column A (Col A) of Table 2 and the corresponding RNA sequences, in particular mRNA sequences comprising preferred coding sequences are provided in column B. Column C (Col C) of Table 2 provides the respective amino acid sequences.

TABLE 2

Nucleic acid, preferably mRNA constructs suitable for a vaccine

| row | A | B | C |
|---|---|---|---|
| 1 | S_stab_PP(K986P_V987P_T19I_L24del_P25del_P26del_A27S_V83A_G142D_Y144del_H146Q_Q183E TABLE 2-continued Nucleic acid, preferably mRNA constructs suitable for a vaccine

| row | A | B | C |
|---|---|---|---|
| 41 | S_stab_PP(K986P_V987P_K444T) | | |
| 42 | S_stab_PP(K986P_V987P_V445P) | | |
| 43 | S_stab_PP(K986P_V987P_F486S) | | |
| 44 | S_stab_PP(K986P_V987P_F490V) | | |
| 45 | S_stab_PP(K986P_V987P_D574V) | | |
| 46 | S_stab_PP(K986P_V987P_T604I) | | |
| 47 | S_stab_PP(K986P_V987P_N658S) | | |
| 48 | S_stab_PP(K986P_V987P_G798D) | | |
| 49 | S_stab_PP(K986P_V987P_S1003I) | | |
| 50 | S_stab_PP(K986P_V987P_A1020S) | | |
| 51 | S_stab_PP(K986P_V987P_D1199N) | | |
| 52 | S_stab_PP(K986P_V987P_K444T_N460K_D614G) | | |
| 53 | S_stab_PP(K986P_V987P_K444M_N460K_D614G) | | |
| 54 | S_stab_PP(K986P_V987P_V83A_H146Q_Q183E_V213E_G252V_G339H_L368I_V445P_N460K_F486S_D614G) | | |
| 55 | S_stab_PP(K986P_V987P_N460K_F490S_D614G) | | |
| 56 | S_stab_PP(K986P_V987P_R346T_N460K_F490S_D614G) | | |
| 57 | S_stab_PP(K986P_V987P_Y144del_R346T_N460K_F490S_D614G) | | |
| 58 | S_stab_PP(K986P_V987P_N460K_D614G) | | |
| 59 | S_stab_PP(K986P_V987P_L452R_N460K_D614G) | | |
| 60 | S_stab_PP(K986P_V987P_R346T_K444T_N460K_D614G) | | |
| 61 | S_stab_PP(K986P_V987P_Y144del_K444M_N460K_D614G) | | |
| 62 | S_stab_PP(K986P_V987P_Y144del_G252V_N460K_D614G) | | |
| 63 | S_stab_PP(K986P_V987P_G339H_R346T_D614G) | | |
| 64 | S_stab_PP(K986P_V987P_R346T_F486S_D614G) | | |
| 65 | S_stab_PP(K986P_V987P_R346T_F486S_D614G_D1199N) | | |
| 66 | S_stab_PP(K986P_V987P_R346T_D614G_N658S) | | |
| 67 | S_stab_PP(K986P_V987P_L452R_T604I_D614G) | | |
| 68 | S_stab_PP(K986P_V987P_K444M_D614G_A1020S) | | |
| 69 | S_stab_PP(K986P_V987P_V83A_H146Q_Q183E_V213E_G252V_G339H_L368I_V445P_N460K_F486S_F490S_D614G) | | |
| 70 | S_stab_PP(K986P_V987P_V83A_D614G) | | |
| 71 | S_stab_PP(K986P_V987P_H146Q_D614G) | | |
| 72 | S_stab_PP(K986P_V987P_K147E_D614G) | | |
| 73 | S_stab_PP(K986P_V987P_Q183E_D614G) | | |
| 74 | S_stab_PP(K986P_V987P_I210V_D614G) | | |
| 75 | S_stab_PP(K986P_V987P_V213E_D614G) | | |
| 76 | S_stab_PP(K986P_V987P_G252V_D614G) | | |
| 77 | S_stab_PP(K986P_V987P_G257S_D614G) | | |
| 78 | S_stab_PP(K986P_V987P_G339H_D614G) | | |
| 79 | S_stab_PP(K986P_V987P_L368I_D614G) | | |
| 80 | S_stab_PP(K986P_V987P_K444M_D614G) | | |
| 81 | S_stab_PP(K986P_V987P_K444T_D614G) | | |
| 82 | S_stab_PP(K986P_V987P_V445P_D614G) | | |
| 83 | S_stab_PP(K986P_V987P_F486S_D614G) | | |
| 84 | S_stab_PP(K986P_V987P_F490V_D614G) | | |
| 85 | S_stab_PP(K986P_V987P_D574V_D614G) | | |
| 86 | S_stab_PP(K986P_V987P_T604I_D614G) | | |
| 87 | S_stab_PP(K986P_V987P_N658S_D614G) | | |
| 88 | S_stab_PP(K986P_V987P_G798D_D614G) | | |
| 89 | S_stab_PP(K986P_V987P_S1003I_D614G) | | |
| 90 | S_stab_PP(K986P_V987P_A1020S_D614G) | | |
| 91 | S_stab_PP(K986P_V987P_D1199N_D614G) | | |
| 92 | S_stab_PP(K986P_V987P_T19I_L24del_P25del_P26del_A27S_G142D_K147E_W152R_F157L_I210V_V213G_G257S_G339H_R346T_K356T_S371F_S373P_S375F_T376A_D405N_R408S_K417N_N440K_G446S_N460K_S477N_T478K_E484A_F490S_Q498R_N501Y_Y505H_D614G_H655Y_N679K_P681H_N764K_D796Y_Q954H_N969K); BN.1 | 171, 177 | 159 |
| 93 | S_stab_PP(K986P_V987P_T19I_L24del_P25del_P26del_A27S_G142D_K147E_W152R_F157L_I210V_V213G_G257S_G339H_R346T_S371F_S373P_S375F_T376A_D405N_R408S_K417N_N440K_G446S_N460K_S477N_T478K_E484A_F486P_F490S_Q498R_N501Y_Y505H_D614G_H655Y_N679K_P681H_N764K_D796Y_Q954H_N969K); XBF | 172, 178 | 160 |
| 94 | S_stab_PP(K986P_V987P_T19I_L24del_P25del_P26del_A27S_G142D_M153T_N164K_V213G_H245N_G257D_G339H_S371F_S373P_S375F_T376A_D405N_R408S_K417N_N440K_K444R_N450D_L452M_N460K_S477N_T478K_E484A_Q498R_N501Y_Y505H_D614G_H655Y_N679K_P681H_N764K_D796Y_Q954H_N969K); CM.2 | 173, 179 | 161 |
| 95 | S_stab_PP(K986P_V987P_T19I_L24del_P25del_P26del_A27S_V83A_G142D_Y144del_H146Q_Q183E_V213E_G252V_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_D614G_H655Y_N679K_P681H_N764K_D796Y_Q954H_N969K); XBB.1.5 | 174, 180, 260 | 162 |
| 96 | S_stab_PP(K986P_V987P_T19I_P25S_G142D_Y144del_E156G_F157del_R158del_P209L_L212S_D215H_A222V_A243del_L244del_S371F_S373P_S375F_T376A_D405N_R408S_K417N_N440K_G446S_L452M_S477N_T478K_E484A_F486P_Q498R_N501Y_Y505H_D614G_H655Y_N679K_P681H_N703I_N764K_D796Y_Q954H_N969K); XBC.1 | 175, 181 | 163 |

TABLE 2-continued

Nucleic acid, preferably mRNA constructs suitable for a vaccine

| row | A | B | C |
|---|---|---|---|
| 97 | S_stab_PP(K986P_V987P_T19I_P25S_K97R_G142D_Y144del_E156G_F157del_R158del_P209L_L212S_D215H_A222V_A243del_L244del_S371F_S373P_S375F_T376A_D405N_R408S_K417N_N440K_G446S_S477N_T478K_E484A_F486P_Q498R_N501Y_Y505H_D614G_H655Y_N679K_P681H_N703I_N764K_D796Y_Q954H_N969K); XBC.2 | 176, 182 | 164 |
| 98 | S_stab_PP(K986P_V987P_T19I_L24del_P25del_P26del_A27S_H69del_V70del_G142D_V213G_G339D_S371F_S373P_S375F_T376A_D405N_R408S_K417N_N440K_K444T_L452R_N460K_S477N_T478K_E484A_F486V_Q498R_N501Y_Y505H_D614G_H655Y_I666V_N679K_P681H_N764K_D796Y_Q954H_N969K); BQ.1.2 | | |
| 99 | S_stab_PP(K986P_V987P_F486P) | | |
| 100 | S_stab_PP(K986P_V987P_F486P_N460K) | | |
| 101 | S_stab_PP(K986P_V987P_R346T_F486P_N460K) | | |
| 102 | S_stab_PP(K986P_V987P_Y144del_F486P_N460K) | | |
| 103 | S_stab_PP(K986P_V987P_F490S_F486P_N460K) | | |
| 104 | S_stab_PP(K986P_V987P_F486P_D614G) | | |
| 105 | S_stab_PP(K986P_V987P_T19I_L24del_P25del_P26del_A27S_H69del_V70del_G142D_Y144del_V213G_G339D_R346T_S371F_S373P_S375F_T376A_D405N_R408S_K417N_N440K_K444T_L452R_N460K_S477N_T478K_E484A_F486V_Q498R_N501Y_Y505H_D614G_H655Y_N679K_P681H_N764K_D796Y_Q954H_N969K); BQ.1.18 | 221, 240 | 183 |
| 106 | S_stab_PP(K986P_V987P_T19I_L24del_P25del_P26del_A27S_V83A_G142D_E180V_Y144del_H146Q_Q183E_V213E_G252V_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_D614G_H655Y_N679K_P681H_N764K_D796Y_Q954H_N969K); XBB.1.16 | 222, 241 | 184 |
| 107 | S_stab_PP(K986P_V987P_T19I_L24del_P25del_P26del_A27S_V83A_G142D_E180V_Y144del_H146Q_Q183E_V213E_G252V_G339H_R346T_L368I_S371F_S373P_S375F_T376A_D405N_R408S_K417N_N440K_V445P_G446S_N460K_S477N_T478R_E484A_F486P_F490S_Q498R_N501Y_Y505H_T547I_D614G_H655Y_N679K_P681H_N764K_D796Y_Q954H_N969K); XBB.1.16.1 | 223, 242 | 185 |
| 108 | S_stab_PP(K986P_V987P_T19I_L24del_P25del_P26del_A27S_V83A_G142D_Y144del_H146Q_Q183E_D215H_V213E_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_D614G_H655Y_N679K_P681H_N764K_D796Y_Q954H_N969K); XBB.1.17.1 | 224, 243 | 186 |
| 109 | S_stab_PP(K986P_V987P_T19I_L24del_P25del_P26del_A27S_V83A_G142D_Y144del_H146Q_Q183E_V213E_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_D614G_H655Y_N679K_P681H_N764K_D796Y_Q954H_N969K); XBB.1.22 | 225, 244 | 187 |
| 110 | S_stab_PP(K986P_V987P_T19I_L24del_P25del_P26del_A27S_V83A_G142D_Y144del_H146Q_Q183E_V213E_D253G_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_P521S_D614G_H655Y_N679K_P681H_N764K_D796Y_Q954H_N969K); XBB.2.3 | 226, 245 | 188 |
| 111 | S_stab_PP(K986P_V987P_T19I_L24del_P25del_P26del_A27S_D80Y_V83A_G142D_Y144del_H146Q_Q183E_V213E_D253G_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_P521S_D614G_H655Y_N679K_P681H_N764K_D796Y_Q954H_N969K); XBB.2.3.1 | 227, 246 | 189 |
| 112 | S_stab_PP(K986P_V987P_T19I_L24del_P25del_P26del_A27S_V83A_G142D_Y144del_H146Q_Q183E_G184V_V213E_D253G_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_P521S_D614G_H655Y_N679K_P681H_N764K_D796Y_Q954H_N969K); XBB.2.3.2 | 228, 247 | 190 |
| 113 | S_stab_PP(K986P_V987P_L18F_T19R_R21G_T95I_W152L_E156G_F157del_R158del_F186L_V213G_G339D_S371F_S373P_S375F_T376A_D405N_R408S_K417N_N440K_G446D_S477N_L452R_T478K_E484A_F486P_Q498R_N501Y_Y505H_D614G_P621S_H655Y_N679K_P681H_A706V_N764K_D796Y_Q954H_N969K_T1117I); XAY.2 | 229, 248 | 191 |
| 114 | S_stab_PP(K986P_V987P_T19I_L24del_P25del_P26del_A27S_V83A_G142D_Y144del_H146K_Q183E_V213E_G252V_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_D614G_H655Y_N679K_P681H_N764K_D796Y_Q954H_N969K); FD.2 | 230, 249 | 192 |
| 115 | S_stab_PP(K986P_V987P_T19I_L24del_P25del_P26del_A27S_H69del_V70del_G142D_V213G_G339D_R346T_S371F_S373P_S375F_T376A_D405N_R408S_K417N_N440K_L452R_S477N_T478K_E484A_F486V_Q498R_N501Y_Y505H_D614G_H655Y_N679K_P681H_N764K_D796Y_Q954H_N969K); BF.7 | 231, 250 | 193 |
| 116 | S_stab_PP(K986P_V987P_T19I_L24del_P25del_P26del_A27S_H69del_V70del_G142D_V213G_R346T_G339D_S371F_S373P_S375F_T376A_D405N_R408S_K417N_N440K_L452R_S477N_T478K_E484A_F486V_Q498R_N501Y_Y505H_D614G_H655Y_N679K_P681H_N764K_D796Y_Q954H_N969K_C1243F); BF.7.14 | 232, 251 | 194 |
| 117 | S_stab_PP(K986P_V987P_T19I_L24del_P25del_P26del_A27S_G142D_K147E_W152R_F157L_I210V_V213G_G257S_G339H_R346T_S371F_S373P_S375F_T376A_D405N_R408S_K417N_N440K_K444T_G446S_N460K_L452R_S477N_T478K_E484A_F486S_Q498R_N501Y_Y505H_D614G_H655Y_N679K_P681H_N764K_D796Y_Q954H_N969K); CH.1.1 | 233, 252 | 195 |

TABLE 2-continued

Nucleic acid, preferably mRNA constructs suitable for a vaccine

| row | A | B | C |
|---|---|---|---|
| 118 | S_stab_PP(K986P_V987P_T19I_L24del_P25del_P26del_A27S_G142D_K147E_W152R_F157L_N185D_I210V_V213G_G257S_G339H_R346T_S371F_S373P_S375F_T376A_D405N_R408S_K417N_N440K_K444T_G446S_N460K_L452R_S477N_T478K_E484A_F486S_Q493R_Q498R_N501Y_Y505H_D614G_H655Y_N679K_P681H_N764K_D796Y_Q954H_N969K) CH.1.1.1 | 234, 253 | 196 |
| 119 | S_stab_PP(K986P_V987P_T19I_L24del_P25del_P26del_A27S_G142D_K147E_W152R_F157L_I210V_V213G_G257S_G339H_R346T_S371F_S373P_S375F_T376A_D405N_R408S_K417N_N440K_K444T_G446S_N460K_L452R_S477N_T478K_E484A_F486S_Q493R_Q498R_N501Y_Y505H_D614G_H655Y_N679K_P681H_N764K_D796Y_T883I_Q954H_N969K); CH.1.1.2 | 235, 254 | 197 |
| 120 | S_stab_PP(K986P_V987P_T19I_L24del_P25del_P26del_A27S_H69del_V70del_G142D_Y144del_V213G_D253G_G339H_R346T_S371F_S373P_S375F_T376A_D405N_R408S_K417N_N440K_K444T_L452R_N460K_S477N_T478K_E484A_F486V_Q498R_N501Y_Y505H_D614G_H655Y_N679K_P681H_N764K_D796Y_Q954H_N969K); DU.1 | 236, 255 | 198 |
| 121 | S_stab_PP(K986P_V987P_T19I_L24del_P25del_P26del_A27S_V83A_G142D_Y144del_H146Q_Q183E_V213G_G252V_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_Q613H_D614G_H655Y_N679K_P681H_N764K_D796Y_Q954H_N969K); EG.1 | 237, 256 | 199 |
| 122 | S_stab_PP(K986P_V987P_T19I_P25S_G142D_Y144del_E156G_F157del_R158del_P209L_L212S_D215H_A222V_A243del_L244del_S256L_R346S_S371F_S373P_S375F_T376A_D405N_R408S_K417N_N440K_G446S_L452R_S477N_T478K_E484A_F486P_Q498R_N501Y_Y505H_D614G_H655Y_N679K_P681H_N703I_N764K_D796Y_Q954H_N969K); XBC.1.6 | 238, 257 | 200 |
| 123 | S_stab_PP(K986P_V987P_T19I_L24del_P25del_P26del_A27S_V83A_G142D_Y144del_H146Q_Q183E_V213E_G252V_G339H_R346T_L368I_S371F_S373P_S375F_T376A_D405N_R408S_I410V_K417N_N440K_V445P_G446S_N460K_S477N_T478K_E484A_F486P_F490S_Q498R_N501Y_Y505H_P521S_D614G_H655Y_N679K_P681H_N764K_D796Y_Q954H_N969K); EU.1.1 | 239, 258 | 201 |
| 124 | S_stab_PP(K986P_V987P_E180V) | | |
| 125 | S_stab_PP(K986P_V987P_R21G) | | |
| 126 | S_stab_PP(K986P_V987P_H146K) | | |
| 127 | S_stab_PP(K986P_V987P_G184V) | | |
| 128 | S_stab_PP(K986P_V987P_N185D) | | |
| 129 | S_stab_PP(K986P_V987P_F186L) | | |
| 130 | S_stab_PP(K986P_V987P_P521S) | | |
| 131 | S_stab_PP(K986P_V987P_Q613H) | | |
| 132 | S_stab_PP(K986P_V987P_T883I) | | |
| 133 | S_stab_PP(K986P_V987P_E1144Q) | | |
| 134 | S_stab_PP(K986P_V987P_C1243F) | | |
| 135 | S_stab_PP(K986P_V987P_D80Y) | | |
| 136 | S_stab_PP(K986P_V987P_D215H) | | |
| 137 | S_stab_PP(K986P_V987P_T547I) | | |
| 138 | S_stab_PP(K986P_V987P_I410V) | | |
| 139 | S_stab_PP(K986P_V987P_E180V_T478R_F486P) | | |
| 140 | S_stab_PP(K986P_V987P_K444T_L452R) | | |
| 141 | S_stab_PP(K986P_V987P_E180V_N460K) | | |
| 142 | S_stab_PP(K986P_V987P_R21G_N440K) | | |
| 143 | S_stab_PP(K986P_V987P_H146K_N460K) | | |
| 144 | S_stab_PP(K986P_V987P_G184V_N460K) | | |
| 145 | S_stab_PP(K986P_V987P_N185D_N460K) | | |
| 146 | S_stab_PP(K986P_V987P_F186L_N440K) | | |
| 147 | S_stab_PP(K986P_V987P_P521S_N460K) | | |
| 148 | S_stab_PP(K986P_V987P_Q613H_N460K) | | |
| 149 | S_stab_PP(K986P_V987P_T883I_N460K) | | |
| 150 | S_stab_PP(K986P_V987P_E1144Q_N460K) | | |
| 151 | S_stab_PP(K986P_V987P_C1243F_N440K) | | |
| 152 | S_stab_PP(K986P_V987P_D80Y_N460K) | | |
| 153 | S_stab_PP(K986P_V987P_D215H_N440K) | | |
| 154 | S_stab_PP(K986P_V987P_T547I_N460K) | | |
| 155 | S_stab_PP(K986P_V987P_I410V_N460K) | | |
| 156 | S_stab_PP(K986P_V987P_E180V_T478R_F486P) | | |
| 157 | S_stab_PP(K986P_V987P_K444T_L452R) | | |
| 158 | S_stab_PP(K986P_V987P_E180V_T478R_F486P_N460K) | | |
| 159 | S_stab_PP(K986P_V987P_K444T_L452R_N460K) | | |
| 160 | S_stab_PP(K986P_V987P_D215G_Q613H_N460K) | | |
| 161 | S_stab_PP(K986P_V987P_T19I_L24del_P25del_P26del_A27S_G142D_K147E_W152R_F157L_I210V_V213G_D215G_G257S_G339H_R346T_S371F_S373P_S375F_T376A_D405N_R408S_K417N_N440K_K444T_G446S_N460K_L452R_S477N_T478K_E484A_F486S_Q498R_N501Y_Y505H_Q613H_D614G_H655Y_N679K_P681H_N764K_D796Y_Q954H_N969K); FK.1 | | |
| 162 | S_stab_PP(K986P_V987P_T19I_L24del_P25del_P26del_A27S_Q52H_V83A_G142D_Y144del_H146Q_Q183E_V213G_G252V_G339H_R346T_L368I_S371F_S373P_S375F_T376A_D405N_R408S_K417N_N440K_V445P_G446S_F456L_N460K_S477N_T478K_E484A_F486P_F490S_Q498R_N501Y_Y505H_D614G_H655Y_N679K_P681H_N764K_D796Y_Q954H_N969K); EG.5.1 | 290, 303 | 264 |

TABLE 2-continued

Nucleic acid, preferably mRNA constructs suitable for a vaccine

| row | A | B | C |
|---|---|---|---|
| 163 | S_stab_PP(K986P_V987P_T19I_L24del_P25del_P26del_A27S_V83A_G142D_Y144del_H146Q_Q183E_V213E_G252V_G339H_R346T_L368I_S371F_S373P_S375F_T376A_D405N_R408S_K417N_N440K_V445P_G446S_F456L_N460K_S477N_T478K_E484A_F486P_F490S_Q498R_N501Y_Y505H_D614G_H655Y_N679K_P681H_N764K_D796Y_Q954H_N969K); EG.5 (FE.1/XBB.1.18.1.1) | 291, 304 | 265 |
| 164 | S_stab_PP(K986P_V987P_T19I_L24del_P25del_P26del_A27S_V83A_G142D_Y144del_H146Q_K182N_Q183E_V213E_D253G_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_P521S_D614G_H655Y_N679K_P681H_N764K_D796Y_Q954H_N969K); XBB.2.3.3 | 292, 305 | 266 |
| 165 | S_stab_PP(K986P_V987P_T19I_L24del_P25del_P26del_A27S_V83A_G142D_Y144del_H146Q_Q183E_V213E_D253G_G339H_R346T_L368I_S371F_S373P_S375F_T376A_D405N_R408S_K417N_N440K_V445P_G446S_N460K_S477N_T478Q_E484A_F486P_F490S_Q498R_N501Y_Y505H_P521S_D614G_H655Y_N679K_P681H_N764K_D796Y_Q954H_N969K); XBB.2.4 | 293, 306 | 267 |
| 166 | S_stab_PP(K986P_V987P_T19I_L24del_P25del_P26del_A27S_V83A_G142D_Y144del_H146Q_Q183E_V213E_G252V_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_L518V_D614G_H655Y_N679K_P681H_N764K_D796Y_Q954H_N969K); GB.1 | 294, 307 | 268 |
| 167 | S_stab_PP(K986P_V987P_T19I_L24del_P25del_P26del_A27S_V83A_G142D_Y144del_H146Q_Q183E_V213E_G252V_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_D614G_H655Y_N679K_P681H_A701V_N764K_D796Y_Q954H_N969K); FL.1 (FL.1.3) | 295, 308 | 269 |
| 168 | S_stab_PP(K986P_V987P_T19I_L24del_P25del_P26del_A27S_G142D_K147N_M153T_N164K_V213G_H245N_G257D_G339D_R346T_S371F_S373P_S375F_T376A_D405N_R408S_K417N_N440K_K444R_G446S_N450D_L452M_N460K_S477N_T478K_E484R_F486S_Q498R_N501Y_Y505H_D614G_H655Y_N679K_P681H_N764K_D796Y_Q954H_N969K); FV.1 | 296, 309 | 270 |
| 169 | S_stab_PP(K986P_V987P_T19I_L24del_P25del_P26del_A27S_V83A_G142D_Y144del_H146Q_E180V_Q183E_V213E_G252V_G339H_R346T_L368I_S371F_S373P_S375F_T376A_D405N_R408S_K417N_N440K_V445P_G446S_F456L_N460K_S477N_T478K_E484A_F486P_F490S_Q498R_N501Y_Y505H_D614G_H655Y_N679K_P681H_N764K_D796Y_Q954H_N969K); XBB.1.16.6 | 297, 310 | 271 |
| 170 | S_stab_PP(K986P_V987P_T19I_L24del_P25del_P26del_A27S_V83A_G142D_Y144del_H146Q_Q183E_V213E_G252V_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_E554K_D614G_H655Y_N679K_P681H_N764K_D796Y_Q954H_N969K); XBB.1.19.1 | 298, 311 | 272 |
| 171 | S_stab_PP(K986P_V987P_T19I_L24del_P25del_P26del_A27S_V83A_G142D_Y144del_H146Q_Q183E_Y200C_V213E_G252V_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_D614G_H655Y_N679K_P681H_N764K_D796Y_Q954H_N969K); XBB.1.22.1 | 299, 312 | 273 |
| 172 | S_stab_PP(K986P_V987P_T19I_L24del_P25del_P26del_A27S_V83A_G142D_Y144del_H146Q_Q183E_V213E_G252V_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_D614G_H655Y_Q675H_N679K_P681H_N764K_D796Y_Q954H_N969K); EL.1 | 300, 313 | 274 |
| 173 | S_stab_PP(K986P_V987P_L18F_T19R_R21G_T95I_G142D_W152L_E156G_F157del_R158del_F186L_V213G_D253G_G339D_R346T_S371F_S373P_S375F_T376A_D405N_R408S_K417N_N440K_G446D_L452R_S477N_T478K_E484A_F486P_Q498R_N501Y_Y505H_D614G_P621S_H655Y_N679K_P681H_A706V_N764K_D796Y_Q954H_N969K_T1117I_D1153Y); XAY.1.1.1 | 301, 314 | 275 |
| 174 | S_stab_PP(K986P_V987P_T19I_L24del_P25del_P26del_A27S_V83A_G142D_Y144del_H146Q_Q183E_V213E_G252V_G339H_R346T_K356T_L368I_S371F_S373P_S375F_T376A_D405N_R408S_K417N_N440K_V445P_G446S_N460K_S477N_T478K_E484A_F486P_F490S_Q498R_N501Y_Y505H_T572I_D614G_H655Y_N679K_P681H_N764K_D796Y_Q954H_N969K); XBB.1.5.44 | 302, 315 | 276 |
| 175 | S_stab_PP(K986P_V987P_K182N) | | |
| 176 | S_stab_PP(K986P_V987P_Y200C) | | |
| 177 | S_stab_PP(K986P_V987P_Q675H) | | |
| 178 | S_stab_PP(K986P_V987P_L518V) | | |
| 179 | S_stab_PP(K986P_V987P_E554K) | | |
| 180 | S_stab_PP(K986P_V987P_T572I) | | |
| 181 | S_stab_PP(K986P_V987P_D1153Y) | | |
| 182 | S_stab_PP(K986P_V987P_K182N_N460K) | | |
| 183 | S_stab_PP(K986P_V987P_Y200C_N460K) | | |
| 184 | S_stab_PP(K986P_V987P_Q675H_N460K) | | |
| 185 | S_stab_PP(K986P_V987P_L518V_N460K) | | |
| 186 | S_stab_PP(K986P_V987P_E554K_N460K) | | |
| 187 | S_stab_PP(K986P_V987P_T572I_N460K) | | |
| 188 | S_stab_PP(K986P_V987P_D1153Y_D614G) | | |
| 189 | S_stab_PP(K986P_V987P_K182N_N460K_D614G) | | |
| 190 | S_stab_PP(K986P_V987P_Y200C_N460K_D614G) | | |
| 191 | S_stab_PP(K986P_V987P_Q675H_N460K_D614G) | | |

TABLE 2-continued

Nucleic acid, preferably mRNA constructs suitable for a vaccine

| row | A | B | C |
|---|---|---|---|
| 192 | S_stab_PP(K986P_V987P_L518V_N460K_D614G) | | |
| 193 | S_stab_PP(K986P_V987P_E554K_N460K_D614G) | | |
| 194 | S_stab_PP(K986P_V987P_T572I_N460K_D614G) | | |

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 102-112, 127-137, 171-176, 177-182, 221-239, 240-258, 260, 261, 263, 290-302, 303-315 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs provided in Column B of Table 2 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 102 or 127 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 103 or 128 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA, preferably the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 104 or 129 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-In certain embodiments, the RNA, preferably the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 105 or 130 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 106 or 131 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 107 or 132 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 108 or 133 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 109 or 134 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 110 or 135 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 111 or 136 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 112 or 137 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 171 or 177 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 172 or 178 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 173 or 179 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 174 or 180 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 175 or 181 or a fragment or variant of any of these sequences.

In preferred embodiments, the RNA comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NO: 174, or a fragment or variant of this sequence.

In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 176 or 182 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In preferred embodiments, the RNA of the invention comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NO: 180, or a fragment or variant of this sequence.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 221 or 240 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 222 or 241 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 223 or 242 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 224 or 243 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 225 or 244 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 226 or 245 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 227 or 246 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 228 or 247 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 229 or 248 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 230 or 249 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 231 or 250 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 232 or 251 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 233 or 252 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 234 or 253 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 235 or 254 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 236 or 255 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 237 or 256 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 238 or 257 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 239 or 258 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 290 or 303 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 291 or 304 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 292 or 305 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 293 or 306 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 294 or 307 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 295 or 308 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 296 or 309 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 297 or 310 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 298 or 311 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 299 or 312 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 300 or 313 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 301 or 314 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 302 or 315 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NO: 260 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NO: 261 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In certain embodiments, the RNA or the mRNA, comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NO: 263 or a fragment or variant of any of these sequences. In embodiments at least one uracil nucleotide in said RNA sequences is replaced by pseudouridine (ψ) nucleotides and/or N1-methylpseudouridine (m1ψ) nucleotides. In embodiments all uracil nucleotides in said RNA sequences are replaced by pseudouridine (ψ) nucleotides and/or N1-methylpseudouridine (m1ψ) nucleotides.

In embodiments, the RNA of the invention may be prepared using any method known in the art, including chemical synthesis such as e.g. solid phase RNA synthesis, as well as in vitro methods, such as RNA in vitro transcription reactions. Accordingly, in embodiments, the RNA is obtained by RNA in vitro transcription.

Accordingly, in embodiments, the RNA of the invention is an in vitro transcribed RNA.

The terms "RNA in vitro transcription" or "in vitro transcription" relate to a process wherein RNA is synthesized in a cell-free system (in vitro). RNA may be obtained by DNA-dependent in vitro transcription of an appropriate DNA template, which according to the present invention is a linearized plasmid DNA template or a PCR-amplified DNA template. The promoter for controlling RNA in vitro transcription can be any promoter for any DNA-dependent RNA polymerase. DNA-dependent RNA polymerases include, but are not limited to, the T7, T3, SP6, or Syn5 RNA polymerases. In embodiments, the DNA template is linearized with a suitable restriction enzyme, before it is subjected to RNA in vitro transcription.

Reagents used in RNA in vitro transcription typically include: a DNA template (linearized plasmid DNA or PCR product) with a promoter sequence that has a high binding affinity for its respective RNA polymerase such as bacteriophage-encoded RNA polymerases (T7, T3, SP6, or Syn5); ribonucleotide triphosphates (NTPs) for the four bases (adenine, cytosine, guanine and uracil); optionally, a cap analogue as defined herein; optionally, further modified nucleotides as defined herein; a DNA-dependent RNA polymerase capable of binding to the promoter sequence within the DNA template (e.g. T7, T3, SP6, or Syn5 RNA polymerase); optionally, a ribonuclease (RNase) inhibitor to inactivate any potentially contaminating RNase; optionally, a pyrophosphatase to degrade pyrophosphate, which may inhibit RNA in vitro transcription; MgCl2, which supplies Mg2+ ions as a co-factor for the polymerase; a buffer (TRIS or HEPES) to maintain a suitable pH value, which can also contain antioxidants (e.g. DTT), and/or polyamines such as spermidine at optimal concentrations, e.g. a buffer system comprising TRIS-Citrate as disclosed in WO2017/109161.

In preferred embodiments, the cap1 structure of the RNA of the invention is formed using co-transcriptional capping using tri-nucleotide cap analogues m7G(5')ppp(5')(2'OMeA)pG or m7G(5')ppp(5')(2'OMeG)pG. A preferred cap1 analogue that may suitably be used in manufacturing the coding RNA of the invention is m7G(5')ppp(5')(2'OMeA)pG.

In a preferred embodiment, the cap1 structure of the RNA of the invention is formed using co-transcriptional capping using tri-nucleotide cap analogue 3'OMe-m7G(5')ppp(5')(2'OMeA)pG.

In other embodiments, a capO structure of the RNA of the invention is formed using co-transcriptional capping using cap analogue 3'OMe-m7G(5')ppp(5')G.

In additional embodiments, the nucleotide mixture used in RNA in vitro transcription may additionally comprise modified nucleotides as defined herein. In that context, preferred modified nucleotides may be selected from pseudouridine (ψ), N1-methylpseudouridine (m1ψ), 5-methylcytosine, and 5-methoxyuridine. In particular embodiments, uracil nucleotides in the nucleotide mixture are replaced (either partially or completely) by pseudouridine (ψ) and/or N1-methylpseudouridine (m1ψ) to obtain a modified RNA.

In embodiments, the nucleotide mixture used in RNA in vitro transcription does not comprise modified nucleotides as defined herein. In embodiments, the nucleotide mixture used in RNA in vitro transcription does only comprise G, C, A and U nucleotides, and, optionally, a cap analog as defined herein.

In embodiments, the nucleotide mixture (i.e. the fraction of each nucleotide in the mixture) used for RNA in vitro transcription reactions may be optimized for the given RNA sequence, as described in WO2015/188933, the entire contents of which are hereby incorporated by reference.

In this context the in vitro transcription has been performed in the presence of a sequence optimized nucleotide mixture and optionally a cap analog.

In this context a sequence-optimized nucleoside triphosphate (NTP) mix is a mixture of nucleoside triphosphates (NTPs) for use in an in vitro transcription reaction of an RNA molecule of a given sequence comprising the four nucleoside triphosphates (NTPs) GTP, ATP, CTP and UTP, wherein the fraction of each of the four nucleoside triphosphates (NTPs) in the sequence-optimized nucleoside triphosphate (NTP) mix corresponds to the fraction of the respective nucleotide in said RNA molecule. If a ribonucleotide is not present in the RNA molecule, the corresponding nucleoside triphosphate is also not present in the sequence-optimized nucleoside triphosphate (NTP) mix.

In embodiments where more than one different RNA as defined herein have to be produced, e.g. where 2, 3, 4, 5, 6, 7, 8, 9, 10 or even more different RNAs have to be produced (see second aspect), procedures as described in WO2017/109134 may suitably be used.

In the context of RNA-based vaccine production, it may be required to provide GMP-grade nucleic acids, e.g. a GMP grade RNA. GMP-grade RNA may be produced using a manufacturing process approved by regulatory authorities.

Accordingly, in embodiments, RNA production is performed under current good manufacturing practice (GMP), implementing various quality control steps on DNA (template) and RNA level, according to WO2016/180430. In embodiments, the RNA of the invention is a GMP-grade RNA, such as a GMP-grade mRNA. Accordingly, in embodiments, an RNA for a vaccine is a GMP grade RNA.

The obtained RNA products are purified using PureMessenger® (CureVac, Tübingen, Germany; RP-HPLC according to WO2008/077592) and/or tangential flow filtration (as described in WO2016/193206) and/or oligo d(T) purification (see WO2016/180430). Alternatively, the obtained RNA products are purified with oligo d(T) purification, followed by an optional enzymatic capping step, followed by AEX (Anion Exchange Chromatography).

In further embodiments, the RNA is lyophilized (e.g. according to WO2016/165831 or WO2011/069586, the entire content of both PCT applications are hereby incorporated by reference) to yield a temperature stable dried RNA (powder). The RNA may also be dried using spray-drying or spray-freeze drying (e.g. according to WO2016/184575 or WO2016/184576) to yield a temperature stable RNA (powder) as defined herein. Accordingly, in the context of manufacturing and purifying nucleic acid, in particular RNA, the disclosures of WO2017/109161, WO2015/188933, WO2016/180430, WO2008/077592, WO2016/193206, WO2016/165831, WO2011/069586, WO2016/184575, and WO2016/184576 are incorporated herewith by reference.

Accordingly, in embodiments, the RNA is a dried RNA.

The term "dried RNA" as used herein has to be understood as RNA that has been lyophilized, or spray-dried, or spray-freeze dried as defined above to obtain a temperature stable dried RNA (powder).

In embodiments, the nucleic acid of the invention is a purified nucleic acid, such as a purified RNA.

The term "purified nucleic acid" as used herein should be understood as nucleic acid which has a higher purity after certain purification steps than the starting material. Typical impurities that are essentially not present in purified nucleic acid comprise peptides or proteins, spermidine, BSA, abortive nucleic acid sequences, nucleic acid fragments, free nucleotides, bacterial impurities, or impurities derived from purification procedures. Accordingly, it is desirable in this regard for the "degree of nucleic acid purity" to be as close as possible to 100%. It is also desirable for the degree of nucleic acid purity that the amount of full-length nucleic acid is as close as possible to 100%.

Accordingly, "purified nucleic acid" as used herein has a degree of purity of more than 75%, 80%, 85%, 90%, 91%, 92%, 93%, 94%, 95%, 96%, 97%, 98% and most favorably 99% or more. The degree of purity may for example be determined by an analytical HPLC, wherein the percentages provided above correspond to the ratio between the area of the peak for the target nucleic acid and the total area of all peaks representing the by-products. Alternatively, the degree of purity may for example be determined by an analytical agarose gel electrophoresis or capillary gel electrophoresis.

In embodiments, the nucleic acid of the invention is a purified RNA.

The term "purified RNA" or "purified mRNA" as used herein should be understood as RNA which has a higher purity after certain purification steps (e.g. high performance liquid chromatography or HPLC, tangential flow filtration or TFF, Oligo d(T) purification, precipitation steps, anion exchange chromatography or AEX, cellulose purification) than the starting material (e.g. in vitro transcribed RNA). Typical impurities that are essentially not present in purified RNA comprise peptides or proteins (e.g. enzymes derived from DNA dependent RNA in vitro transcription, e.g. RNA polymerases, RNases, pyrophosphatase, restriction endonuclease, DNase), spermidine, BSA, abortive RNA sequences, RNA fragments (short double stranded RNA fragments, abortive sequences etc.), free nucleotides (modified nucleotides, conventional NTPs, cap analogue), template DNA fragments, buffer components (HEPES, TRIS, MgCl2) etc. Other potential impurities that may be derived from e.g. fermentation procedures comprise bacterial impurities (bioburden, bacterial DNA) or impurities derived from purification procedures (organic solvents etc.). Accordingly, it is desirable in this regard for the "degree of RNA purity" to be as close as possible to 100%. It is also desirable for the degree of RNA purity that the amount of full-length RNA transcripts is as close as possible to 100%. Accordingly, "purified RNA" as used herein has a degree of purity of more than 75%, 80%, 85%, 90%, 91%, 92%, 93%, 94%, 95%, 96%, 97%, 98% and most favorably 99% or more. The degree of purity may for example be determined by an analytical HPLC, wherein the percentages provided above correspond to the ratio between the area of the peak for the target RNA and the total area of all peaks representing the by-products. Alternatively, the degree of purity may for example be determined by an analytical agarose gel electrophoresis or capillary gel electrophoresis.

In embodiments, the RNA has been purified by RP-HPLC and/or TFF to remove double-stranded RNA, non-capped RNA and/or RNA fragments.

The formation of double stranded RNA as side products during e.g. RNA in vitro transcription can lead to an induction of the innate immune response, such as IFNalpha which is the main factor of inducing fever in vaccinated subjects, which is of course an unwanted side effect. Current techniques for immunoblotting of dsRNA (via dot Blot, serological specific electron microscopy (SSEM) or ELISA for example) are used for detecting and sizing dsRNA species from a mixture of nucleic acids.

Suitably, the RNA of the invention has been purified by RP-HPLC and/or TFF as described herein to reduce the amount of dsRNA.

In embodiments, the RNA according to the invention is purified using RP-HPLC, using Reversed-Phase High pressure liquid chromatography (RP-HPLC) with a macroporous styrene/divinylbenzene column (e.g. particle size 30 μm, pore size 4000 A and additionally using a filter cassette with a cellulose-based membrane with a molecular weight cutoff of about 100 kDa.

In this context, the purified RNA has been purified by RP-HPLC and/or TFF which results in about 5%, 10%, or 20% less double stranded RNA side products as in RNA that has not been purified with RP-HPLC and/or TFF.

Accordingly, the RNA of the invention comprises about 5%, 10%, or 20% less double stranded RNA side products as an RNA that has not been purified with RP-HPLC and/or TFF.

The methods described herein may be applied to a method of producing an RNA composition or vaccine as described in further detail below.

Composition, Pharmaceutical Composition:

A second aspect relates to a composition comprising at least one RNA of the first aspect.

Notably, embodiments relating to the composition of the second aspect may likewise be read on and be understood as suitable embodiments of the vaccine of the third aspect. Also, embodiments relating to the vaccine of the third aspect may likewise be read on and be understood as suitable embodiments of the composition of the second aspect (comprising at least one RNA of the first aspect). Furthermore, features and embodiments described in the context of the first aspect (the RNA of the invention) have to be read on and have to be understood as suitable embodiments of the composition of the second aspect.

In embodiments, the composition comprises at least one RNA according to the first aspect encoding at least one SARS-CoV-2 spike protein or an immunogenic fragment or immunogenic variant thereof, wherein the SARS-CoV-2 spike protein comprises at least one amino acid substitution, deletion or insertion, wherein the at least one amino acid substitution, deletion or insertion is located at a position selected from the group consisting of: N460, K444, T604, D574, K182, Y200, L518, E554, T572, Q675, D1153, E180, R21, V83, K97, H146, K147, N164, Q183, G184, N185, F186, P209, S256, G257, K356, L368, I410, P521, N658, I666, G798, T883, S1003, A1020, E1144, D1199 and C1243, relative to the sequence of SEQ ID NO: 1.

In further embodiments, the composition comprises at least one RNA according to the first aspect encoding at comprising at least one coding sequence encoding at least one SARS-CoV-2 spike protein or an immunogenic fragment or immunogenic variant thereof, wherein the SARS-CoV-2 spike protein comprises at least one amino acid substitution selected from the group consisting of: N460K, K444M, K444R, K444T, V445P, E484R, F486P, K356T, D574V, T604I, Q52H, K147N, K182N, Y200C, T478Q, L518V, E554K, Q675H, T572I, D1153Y, E180V, P25S, V83A, H146Q, K147E, Q183E, I210V, L212S, V213E, D215H, H245N, G252V, G257D, G257S, G339H, L368I, N450D, F486S, F490V, N658S, G798D, S1003I, A1020S, D1199N, K97R, N164K, P209L, S256L, I666V, R21G, H146K, G184V, N185D, F186L, P521S, T883I, E1144Q, C1243F, D80Y, T547I or I410V, relative to the sequence of SEQ ID NO: 1.

In embodiments, the composition comprises at least one RNA encoding at least one antigenic peptide or protein that is selected or is derived from a SARS-CoV-2 spike protein, or an immunogenic fragment or immunogenic variant thereof according to the first aspect, wherein said composition is to be administered intramuscularly or intradermal.

In embodiments, intramuscular or intradermal administration of said composition results in expression of the encoded SARS-CoV-2 spike protein construct in a subject. In embodiments, administration of the composition results in translation of the RNA and to a production of the encoded SARS-CoV-2 spike protein in a subject.

In preferred embodiments, the composition of the second aspect is suitable for a vaccine, in particular, suitable for a SARS-CoV-2 vaccine, such as a SARS-CoV-2 vaccine against at least one of the following SARS-CoV-2 isolates/variants: B.1.1.529 (Omicron), BA.1 (Omicron), BA.2 (Omicron), BA.4 (Omicron), BA.5 (Omicron), B.1.1.7 (Alpha), B.1.351 (Beta), P.1 (Gamma), B.1.617.2 (Delta), C.37 (Lambda), BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44.

In embodiments, the composition of the second aspect is suitable for a SARS-CoV-2 vaccine against BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44. In some embodiments, the composition of the second aspect is suitable for a SARS-CoV-2 vaccine against BQ.1.1, XBB.1, BF.5, BA.2.75, BA.2.75.1, BA.2.75.2, BM1.1, BM.1.1.1, CA.1, BU.1, BJ.1, BJ.1.v1. In some embodiments, the composition of the second aspect is suitable for a SARS-CoV-2 vaccine against XBB.1.5, XBC.1, XBC.2, XBF, CM.2, BN.1, XBB.1.16 or CH.1.1. In some particularly preferred embodiments, the composition of the second aspect is suitable for a SARS-CoV-2 vaccine against XBB.1.5, XBB.1.6, XBB.1.6.1, XBB.1.16.6 or EG.5.1.

In embodiments, the composition of the second aspect is suitable for a SARS-CoV-2 vaccine against a newly emerging SARS-CoV-2 variant.

In the context of the invention, a "composition" refers to any type of composition in which the specified ingredients (e.g. RNA encoding at least one antigenic peptide or protein that is selected or is derived from SARS-CoV-2, e.g. in association with a lipid-based carrier) may be incorporated, optionally along with any further constituents, usually with at least one pharmaceutically acceptable carrier or excipient. The composition may be a dry composition such as a powder or granules, or a solid unit such as a lyophilized form. Alternatively, the composition may be in liquid form, and each constituent may be independently incorporated in dissolved or dispersed (e.g. suspended or emulsified) form.

In embodiments of the second aspect, the composition comprises at least one RNA of the first aspect, and optionally, at least one pharmaceutically acceptable carrier or excipient.

The term "pharmaceutically acceptable carrier" or "pharmaceutically acceptable excipient" as used herein includes the liquid or non-liquid basis of the composition for administration. If the composition is provided in liquid form, the carrier may be water, e.g. pyrogen-free water; isotonic saline or buffered (aqueous) solutions, e.g. phosphate, citrate etc. buffered solutions. Water or preferably a buffer, more preferably an aqueous buffer, may be used, containing a sodium salt, such as at least 50 mM of a sodium salt, a calcium salt, such as at least 0.01 mM of a calcium salt, and optionally a potassium salt, such as at least 3 mM of a potassium salt. In embodiments, the sodium, calcium and, optionally, potassium salts may occur in the form of their halogenides, e.g. chlorides, iodides, or bromides, in the form of their hydroxides, carbonates, hydrogen carbonates, or sulfates, etc. Examples of sodium salts include NaCl, NaI, NaBr, $Na_2CO_3$, $NaHCO_3$, $Na_2SO_4$, examples of the optional potassium salts include KCl, KI, KBr, $K_2CO_3$, $KHCO_3$, $K_2SO_4$, and examples of calcium salts include $CaCl_2$, $CaI_2$, $CaBr_2$, $CaCO_3$, $CaSO_4$, $Ca(OH)_2$.

Furthermore, organic anions of the aforementioned cations may be in the buffer. Accordingly, in embodiments, the nucleic acid composition may comprise pharmaceutically acceptable carriers or excipients using one or more pharmaceutically acceptable carriers or excipients to e.g. increase stability, increase cell transfection, permit the sustained or delayed, increase the translation of encoded coronavirus protein in vivo, and/or alter the release profile of encoded coronavirus protein in vivo. In addition to traditional excipients such as any and all solvents, dispersion media, diluents, or other liquid vehicles, dispersion or suspension aids, surface active agents, isotonic agents, thickening or emulsifying agents, preservatives, excipients of the present invention can include, without limitation, lipidoids, liposomes, lipid nanoparticles, polymers, lipoplexes, core-shell nanoparticles, peptides, proteins, cells transfected with polynucleotides, hyaluronidase, nanoparticle mimics and combinations thereof. In embodiments, one or more compatible solid or liquid fillers or diluents or encapsulating compounds may be used as well, which are suitable for administration to a subject. The term "compatible" as used herein means that the constituents of the composition are capable of being mixed with the at least one nucleic acid and, optionally, a plurality of nucleic acids of the composition, in such a manner that no interaction occurs, which would substantially reduce the biological activity or the pharmaceutical effectiveness of the composition under typical use conditions (e.g., intramuscular or intradermal administration). Pharmaceutically acceptable carriers or excipients must have sufficiently high purity and sufficiently low toxicity to make them suitable for administration to a subject to be treated. Compounds which may be used as pharmaceutically acceptable carriers or excipients may be sugars, such as, for example, lactose, glucose, trehalose, mannose, and sucrose; starches, such as, for example, corn starch or potato starch; dextrose; cellulose and its derivatives, such as, for example, sodium carboxymethylcellulose, ethylcellulose, cellulose acetate; powdered tragacanth; malt; gelatin; tallow; solid glidants, such as, for example, stearic acid, magnesium stearate; calcium sulfate; vegetable oils, such as, for example, groundnut oil, cottonseed oil, sesame oil, olive oil, corn oil and oil from theobroma; polyols, such as, for example, polypropylene glycol, glycerol, sorbitol, mannitol and polyethylene glycol; alginic acid.

The at least one pharmaceutically acceptable carrier or excipient of the composition may be selected to be suitable for intramuscular or intradermal delivery/administration of said composition. Accordingly, the composition is a pharmaceutical composition, suitably a composition for intramuscular administration.

Subjects to which administration of the compositions, such as the pharmaceutical composition, is contemplated include, but are not limited to, humans and/or other primates; mammals, including commercially relevant mammals such as cattle, pigs, horses, sheep, cats, dogs, mice, and/or rats; and/or birds, including commercially relevant birds such as poultry, chickens, ducks, geese, and/or turkeys.

Pharmaceutical compositions of the present invention may suitably be sterile and/or pyrogen-free.

Multivalent Compositions of the Invention:

In embodiments, the composition (e.g. multivalent composition) as defined herein may comprise a plurality or at least more than one of the RNA species as defined in the context of the first aspect of the invention. Preferably, the composition as defined herein may comprise 2, 3, 4, 5, 6, 7, 8, 9, or 10 different RNA species each defined in the context of the first aspect.

In embodiments, the composition (e.g. multivalent composition) comprises at least 2, 3, 4, 5, 6, 7, 8, 9, 10 or even more different RNA species as defined in the context of the first aspect, each encoding at least one different SARS-CoV-2 spike protein (as defined in the context of the first aspect).

In embodiments, the composition comprises at least least 2, 3, 4, 5, 6, 7, 8, 9, 10 or even more different RNA species encoding at least one SARS-CoV-2 spike protein or an immunogenic fragment or immunogenic variant thereof, wherein the SARS-CoV-2 spike protein comprises at least one amino acid substitution, deletion or insertion, wherein the at least one amino acid substitution, deletion or insertion is located at a position selected from the group consisting of: N460, K444, T604, D574, K182, Y200, L518, E554, T572, Q675, D1153, E180, R21, V83, K97, H146, K147, N164, Q183, G184, N185, F186, P209, S256, G257, K356, L368, I410, P521, N658, I666, G798, T883, S1003, A1020, E1144, D1199 and C1243, relative to the sequence of SEQ ID NO: 1.

In embodiments, the composition comprises at least 2, 3, 4, 5, 6, 7, 8, 9, 10 or even more different RNA species encoding at comprising at least one coding sequence encoding at least one SARS-CoV-2 spike protein or an immunogenic fragment or immunogenic variant thereof, wherein the SARS-CoV-2 spike protein comprises at least one amino acid substitution selected from the group consisting of: N460K, K444M, K444R, K444T, V445P, E484R, F486P, K356T, D574V, T604I, Q52H, K147N, K182N, Y200C, T478Q, L518V, E554K, Q675H, T572I, D1153Y, E180V, P25S, V83A, H146Q, K147E, Q183E, I210V, L212S, V213E, D215H, H245N, G252V, G257D, G257S, G339H, L368I, N450D, F486S, F490V, N658S, G798D, S1003I, A1020S, D1199N, K97R, N164K, P209L, S256L, I666V, R21G, H146K, G184V, N185D, F186L, P521S, T883I, E1144Q, C1243F, D80Y, T547I or I410V, relative to the sequence of SEQ ID NO: 1.

In this context it is preferred that the different SARS-CoV-2 spike proteins or prefusion stabilized spike proteins have amino acid changes in the spike protein comprising:
K444T and N460K;
K444M and N460K;
N460K and E180V,
N460K and D215H,
N460K and P521S,
N460K and D80Y,
N460K and G184V,
N460K and N185D,
N460K and T883I,
N460K and E1144Q,
N460K and Q613H,
V83A, H146Q, Q183E, V213E, G252V, G339H, L368I, V445P, N460K, and F486S;
N460K and F490S;
N460K, R346T and F490S;
N460K, R346T, F490S and Y144del;
N460K, and D614G;
N460K, D614G, and L452R;
N460K, K444T, and R346T;
N460K, K444M, and Y144del;
N460K, G252V. and Y144del;
G339H and R346T;
F486S and R346T;
F486S, D1199N, and R346T;
N658S and R346T;
T604I and L452R;
K444M, A1020S, and D614G;
V83A, H146Q, Q183E, V213E, G252V, G339H, L368I, V445P, N460K, F486S, and F490S;
N460K, D614G, and F490S;
N460K, R346T, D614G, and F490S;
N460K, R346T, F490S, D614G, and Y144del;
N460K, D614G, and L452R;
N460K, K444T, D614G, and R346T;
N460K, K444M, D614G, and Y144del;
N460K, G252V, D614G, and Y144del;
G339H, D614G, and R346T;
F486S, D614G, and R346T;
F486S, D1199N, D614G, and R346T;
N658S, D614G, and R346T
T604I, D614G, and L452R;
F486P and F490S;
F486P, R346T and F490S;
F486P, R346, F490 and Y144del;
F486P, and D614G;
N460K, F486P and F490S;
N460K, F486P, R346T and F490S;
N460K, F486P, R346T, F490S and Y144del;
N460K, F486P, and D614del;
P209L and L452M;
P209L and D614G;
P209L and Y144del;
P209L, L452M and Y144del;
S256L and L452M;
S256L and D164G;
S256L and Y144del;
S256L, L452M and Y144del;
P209L, S256L and L452M;
P209L, S256L and D164G;
P209L, S256L and Y144del;
P209L, S256L, L452M and Y144del;
K356T and F490S;
K356T and R346T;
K356T and D614G;
K356T, F490S and R346T;
K356T, F490S, R346T and D614G;
I666V and R346T;
I666V and D614G;
I666V, R346T and D614G;
N460K and I666V;
N460K, I666V and R346T;
N460K, I666V and D614G;
N164K and K444R;
N164K and L452M;
N164K and D614G;
R21G and F186L,
I410V and P521 S,
N460K, E180V, T478R and F486P,
N460K, K444T and L452R,
N164K, K444R and L452M;
N164K, K444R, L452M and D614G;
N460K, N164K and K444R;
N460K, N164K and L452M;
N460K, N164K and D614G;
N460K, N164K, K444R and L452M;
N460K, N164K, K444R, L452M and D614G;
N460K, D215G and Q613H;
N460K and K182N;
N460K and Y200C;
N460K and Q615H;
N460K and L518V;
N460K and E554K;
N460K and T572I;
N460K, K182N and D614G;
N460K, Y200C and D614G;
N460K, Q615H and D614G;
N460K, L518V and D614G;
N460K, E554K and D614G;
N460K, T572I and D614G;
N460K, K182N and F490S;
N460K, Y200C and F490S;
N460K, Q615H and F490S;
N460K, L518V and F490S;
N460K, E554K and F490S,
N460K, T572I and F490S,
N460K, K182N, R346T, and F490S,
N460K, Y200C, R346T, and F490S,
N460K, Q615H, R346T, and F490S,
N460K, L518V, R346T, and F490S,
N460K, E554K, R346T, and F490S,
N460K, T572I, R346T, and F490S,
N460K, K182N, R346T, F490S and Y144del,
N460K, Y200C, R346T, F490S and Y144del,
N460K, Q615H, R346T, F490S and Y144del,
N460K, L518V, R346T, F490S and Y144del,
N460K, E554K, R346T, F490S and Y144del,
N460K, T572I, R346T, F490S and Y144del,
K182N and F490S,
K182N and D614G,
K182N and Y144del,
K182N and F486S,
K182N and R346T,
Y200C and F490S,
Y200C and D614G,
Y200C and Y144del,
Y200C and F486S,
Y200C and R346T,
N460K, K182N, F486P, R346T, F490S and Y144del,
N460K, Y200C, F486P, R346T, F490S and Y144del,
N460K, Q615H, F486P, R346T, F490S and Y144del,
N460K, L518V, F486P, R346T, F490S and Y144del, N460K, E554K, F486P, R346T, F490S and Y144del,
N460K, T572I, F486P, R346T, F490S and Y144del,
K182N and F490S,
K182N and D614G,
K182N and Y144del,
K182N and F486S,
K182N and R346T,
Y200C and F490S,
Y200C and D614G,
Y200C and Y144del,
Y200C and F486S,
Y200C and R346T,
K182N, D614G and F490S,
K182N, D614G and Y144del,
K182N, D614G and F486S,
K182N, D614G and R346T,
Y200C, D614G and F490S,
Y200C, D614G and Y144del,
Y200C, D614G and F486S,
Y200C, D614G and R346T,
Q615H, D614G and F490S,
Q615H, D614G and Y144del,
Q615H, D614G and F486S,
Q615H, D614G and R346T,
L518V, D614G and F490S,
L518V, D614G and Y144del,
L518V, D614G and F486S,
L518V, D614G and R346T,
E554K, D614G and F490S,
E554K, D614G and Y144del,
E554K, D614G and F486S,
E554K, D614G and R346T,
T572I, D614G and F490S,
T572I, D614G and Y144del,
T572I, D614G and F486S,
T572I, D614G and R346T,
D1153Y and D614G,
D1153Y and F486S,
D1153Y and R346T;
D1153Y and L452R;
D1153Y, D614G and F486S;
D1153Y, D614G and R346T;
D1153Y, D614G and L452R;
D1153Y, D614G, R346T and F486S;
D1153Y, D614G, R346T and L452R;
D1153Y, D614G, R346T, F486S and L452R;
V83A, H146Q, Q183E, V213E, G252V, G339H, L368I, V445P, N460K, F486P, D614G, and F490S; or
V83A, H146Q, Q183E, V213E, G252V, G339H, L368I, V445P, N460K, F486S, D614G, and F490S.

In this context the different SARS-CoV-2 spike proteins or prefusion stabilized spike proteins may have amino acid changes in the spike protein comprising:

T19I, L24del, P25del, P26del, A27S, H69del, V70del, G142D, V213G, G339D, R346T, S371F, S373P, S375F, T376A, D405N, R408S, K417N, N440K, K444T, L452R, N460K, S477N, T478K, E484A, F486V, Q498R, N501Y, Y505H, D614G, H655Y, N679K, P681H, N764K, D796Y, Q954H, N969K (BQ.1.1), T19I, L24del, P25del, P26del, A27S, H69del, V70del, G142D, V213G, G339D, S371F, S373P, S375F, T376A, D405N, R408S, K417N, N440K, K444T, L452R, N460K, S477N, T478K, E484A, F486V, Q498R, N501Y, Y505H, D614G, H655Y, I666V, N679K, P681H, N764K, D796Y, Q954H, N969K (BQ.1.2), T19I, L24del, P25del, P26del, A27S, H69del, V70del, G142D, Y144del, V213G, G339D, R346T, S371F, S373P, S375F, T376A, D405N, R408S, K417N, N440K, K444T, L452R, N460K, S477N, T478K, E484A, F486V, Q498R, N501Y, Y505H, D614G, H655Y, N679K, P681H, N764K, D796Y, Q954H, N969K (BQ.1.18), T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486S, F490S, Q498R, N501Y, Y505H, D614G, H655Y, N679K, P681H, N764K, D796Y, Q954H, and N969K (XBB.1), T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, N764K, D796Y, Q954H, N969K (XBB.1.5), T19I, L24del, P25del, P26del, A27S, V83A, G142D, E180V, Y144del, H146Q, Q183E, V213E, G252V, G339H, R346T, L368I, S371F, S373P, S375F, T376A, D405N, R408S, K417N, N440K, V445P, G446S, N460K, S477N, T478R, E484A, F486P, F490S, Q498R, N501Y, Y505H, D614G, H655Y, N679K, P681H, N764K, D796Y, Q954H, N969K (XBB.1.16), T19I, L24del, P25del, P26del, A27S, V83A, G142D, E180V, Y144del, H146Q, Q183E, V213E, G252V, G339H, R346T, L368I, S371F, S373P, S375F, T376A, D405N, R408S, K417N, N440K, V445P, G446S, N460K, S477N, T478R, E484A, F486P, F490S, Q498R, N501Y, Y505H, T547I D614G, H655Y, N679K, P681H, N764K, D796Y, Q954H, N969K (XBB.1.16.1), T19I, L24del, P25del, P26del, A27S, V83A, G142D, Y144del, H146Q, Q183E, V213E, D215H, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, N764K, D796Y, Q954H, N969K (XBB.1.17.1), T19I, L24del, P25del, P26del, A27S, V83A, G142D, Y144del, H146Q, Q183E, V213E, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, N764K, D796Y, Q954H, N969K (XBB.1.22), T19I, L24del, P25del, P26del, A27S, V83A, G142D, Y144del, H146Q, Q183E, V213E, D253G, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, P521S, D614G, H655Y, N679K, P681H, N764K, D796Y, Q954H, N969K (XBB.2.3), T19I, L24del, P25del, P26del, A27S, D80Y, V83A, G142D, Y144del, H146Q, Q183E, V213E, D253G, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, P521S, D614G, H655Y, N679K, P681H, N764K, D796Y, Q954H, N969K (XBB.2.3.1), T19I, L24del, P25del, P26del, A27S, V83A, G142D, Y144del, H146Q, Q183E, G184V, V213E, D253G, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, P521S, D614G, H655Y, N679K, P681H, N764K, D796Y, Q954H, N969K (XBB.2.3.2), L18F, T19R, R21G, T95I, W152L, E156G, F157del, R158del, F186L, V213G, G339D, S371F, S373P, S375F, T376A, D405N, R408S, K417N, N440K, G446D, S477N, L452R T478K, E484A, F486P, Q498R, N501Y, Y505H, D614G, P621S, H655Y, N679K, P681H, A706V N764K, D796Y, Q954H, N969K, T1117I (XAY-2), T19I, L24del, P25del, P26del, A27S, V83A, G142D, Y144del, H146K, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, N764K, D796Y, Q954H, N969K (FD.2), T19I, P25S, G142D, Y144del, E156G, F157del, R158del, P209L, L212S, D215H, A222V, A243del, L244del, S371F, S373P, S375F, T376A, D405N, R408S, K417N, N440K, G446S, L452M, S477N, T478K, E484A, F486P, Q498R, N501Y, Y505H, D614G, H655Y, N679K, P681H, N703I, N764K, D796Y, Q954H, N969K (XBC.1), T19I, P25S, K97R, G142D, Y144del, E156G, F157del, R158del, P209L, L212S, D215H, A222V, A243del, L244del, S371F, S373P, S375F, T376A, D405N, R408S, K417N, N440K, G446S, S477N, T478K, E484A, F486P, Q498R, N501Y, Y505H, D614G, H655Y, N679K, P681H, N703I, N764K, D796Y, Q954H, N969K (XBC.2), T19I, L24del, P25del, P26del, A27S, G142D, M153T, N164K, V213G, H245N, G257D, G339D, S371F, S373P, S375F, T376A, D405N, R408S, K417N, N440K, K444R, N450D, L452M, N460K, S477N, T478K, E484R, Q498R, N501Y, Y505H, D614G, H655Y, N679K, P681H, N764K, D796Y, Q954H, N969K (CM.2), T19I, L24del, P25del, P26del, A27S, G142D, K147E, W152R, F157L, I210V, V213G, G257S, G339H, R346T, K356T, S371F, S373P, S375F, T376A, D405N, R408S, K417N, N440K, G446S, N460K, S477N, T478K, E484A, F490S, Q498R, N501Y, Y505H, D614G, H655Y, N679K, P681H, N764K, D796Y, Q954H, N969K (BN.1), T19I, L24del, P25del, P26del, A27S, G142D, K147E, W152R, F157L, I210V, V213G, G257S, G339H, R346T, S371F, S373P, S375F, T376A, D405N, R408S, K417N, N440K, G446S, N460K, S477N, T478K, E484A, F486P, F490S, Q498R, N501Y, Y505H, D614G, H655Y, N679K, P681H, N764K, D796Y, Q954H, N969K (XBF), T19I, L24del, P25del, P26del, A27S, H69del, V70del, G142D, V213G, G339D, S371F, S373P, S375F, T376A, D405N, R408S, K417N, N440K, L452R, S477N, T478K, E484A, F486V, Q498R, N501Y, Y505H, D614G, H655Y, N679K, P681H, N764K, D796Y, Q954H, N969K, and A1020S (BF.5), T19I, L24del, P25del, P26del, A27S, G142D, K147E, W152R, F157L, I210V, V213G, G257S, G339H, S371F, S373P, S375F, T376A, D405N, R408S, K417N, N440K, G446S, N460K, S477N, T478K, E484A, Q498R, N501Y, Y505H, D614G, H655Y, N679K, P681H, N764K, D796Y, Q954H, and N969K (BA.2.75), T19I, L24del, P25del, P26del, A27S, G142D, K147E, W152R, F157L, I210V, V213G, G257S, G339H, S371F, S373P, S375F, T376A, D405N, R408S, K417N, N440K, G446S, N460K, S477N, T478K, E484A, Q498R, N501Y, Y505H, D574V, D614G, H655Y, N679K, P681H, N764K, D796Y, Q954H, and N969K (BA.2.75.1), T19I, L24del, P25del, P26del, A27S, G142D, K147E, W152R, F157L, I210V, V213G, G257S, G339H, R346T, S371F, S373P, S375F, T376A, D405N, R408S, K417N, N440K, G446S, N460K, S477N, T478K, E484A, F486S, Q498R, N501Y, Y505H, D614G, H655Y, N679K, P681H, N764K, D796Y, Q954H, and N969K, D1199N (BA.2.75.2), T19I, L24del, P25del, P26del, A27S, G142D, K147E, W152R, F157L, I210V, V213G, G257S, G339H, R346T, S371F, S373P, S375F, T376A, D405N, R408S, K417N, N440K, G446S, N460K, S477N, T478K, E484A, F486S, Q498R, N501Y, Y505H, D614G, H655Y, N679K, P681H, N764K, D796Y, Q954H, and N969K (BM1.1), T19I, L24del, P25del, P26del, A27S, G142D, K147E, W152R, F157L, I210V, V213G, G257S, G339H, R346T, S371F, S373P, S375F, T376A, D405N, R408S, K417N, N440K, G446S, N460K, S477N, T478K, E484A, F486S, F490S, Q498R, N501Y, Y505H, D614G, H655Y, N679K, P681H, N764K, D796Y, Q954H, and N969K (BM.1.1.1), T19I, L24del, P25del, P26del, A27S, G142D, K147E, W152R, F157L, I210V, V213G, G257S, G339H, R346T, S371F, S373P, S375F, T376A, D405N, R408S, K417N, N440K, G446S, L452R, N460K, S477N, T478K, E484A, F486S, Q498R, N501Y, Y505H, T604I, D614G, H655Y, N679K, P681H, N764K, D796Y, Q954H, N969K, and D1199N (CA.1), T19I, L24del, P25del, P26del, A27S, H69del, V70del, G142D, Y144del, V213G, G339D, S371F, S373P, S375F, T376A, D405N, R408S, K417N, N440K, K444M, L452R, N460K, S477N, T478K, E484A, F486V, Q498R, N501Y, Y505H, D614G, H655Y, N679K, P681H, N764K, D796Y, Q954H, and N969K (BU.1), T19I, L24del, P25del, P26del, A27S, V83A, G142D, Y144del, H146Q, Q183E, V213E, G339H, R346T, L368I, S371F, S373P, S375F, T376A, D405N, R408S, K417N, N440K, V445P, G446S, S477N, T478K, V483A, E484A, F490V, Q493R, Q498R, N501Y, Y505H, D614G, H655Y, N679K, P681H, N764K, D796Y, G798D, Q954H, N969K, and S1003I (BJ.1), T19I, L24del, P25del, P26del, A27S, V83A, G142D, Y144del, H146Q, Q183E, V213E, G339H, R346T, L368I, D405N, N440K, V445P, G446S, S477N, T478K, V483A, E484A, F490V, Q493R, Q498R, N501Y, Y505H, D614G, H655Y, N679K, P681H, N764K, D796Y, G798D, Q954H, N969K, and S1003I (BJ.1.v1), T19I, L24del, P25del, P26del, A27S, H69del, V70del, G142D, V213G, R346T, G339D, S371F, S373P, S375F, T376A, D405N, R408S, K417N, N440K, L452R, S477N, T478K, E484A, F486V, Q498R, N501Y, Y505H, D614G, H655Y, N679K, P681H, N764K, D796Y, Q954H, N969K (BF.7), T19I, L24del, P25del, P26del, A27S, H69del, V70del, G142D, V213G, R346T, G339D, S371F, S373P, S375F, T376A, D405N, R408S, K417N, N440K, L452R, S477N, T478K, E484A, F486V, Q498R, N501Y, Y505H, D614G, H655Y, N679K, P681H, N764K, D796Y, Q954H, N969K, C1243F (BF.7.14), T19I, L24del, P25del, P26del, A27S, G142D, K147E, W152R, F157L, I210V, V213G, G257S, G339H, R346T S371F, S373P, S375F, T376A, D405N, R408S, K417N, N440K, K444T, G446S, N460K, L452R, S477N, T478K, E484A, F486S, Q498R, N501Y, Y505H, D614G, H655Y, N679K, P681H, N764K, D796Y, Q954H, N969K (CH.1.1), T19I, L24del, P25del, P26del, A27S, G142D, K147E, W152R, F157L, N185D, I210V V213G, G257S, G339H, R346T S371F, S373P, S375F, T376A, D405N, R408S, K417N, N440K, K444T, G446S, N460K, L452R, S477N, T478K, E484A, F486S Q493R, Q498R, N501Y, Y505H, D614G, H655Y, N679K, P681H, N764K, D796Y, Q954H, N969K (CH.1.1.1), T19I, L24del, P25del, P26del, A27S, G142D, K147E, W152R, F157L, I210V V213G, G257S, G339H, R346T S371F, S373P, S375F, T376A, D405N, R408S, K417N, N440K, K444T, G446S, N460K, L452R, S477N, T478K, E484A, F486S Q493R, Q498R, N501Y, Y505H, D614G, H655Y, N679K, P681H, N764K, D796Y, T883I, Q954H, N969K (CH.1.1.2), T19I, L24del, L25del, P26del, A27S, H69del, V70del, G142D, delY144, V213G, D253G, G339D, R346T, S371F, S373P, S375F, T376A, D405N, R408S, K417N, N440K, K444T, L452R, N460K, S477N, T478K, E484A, F486V, Q498R, N501Y, Y505H, D614G, H655Y, N679K, P681H, N764K, D796Y, Q954H, N969K, E1144Q (DU1), T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, Q613H, D614G, H655Y, N679K, P681H, N764K, D796Y, Q954H, N969K (EG1), T19I, L24del, P25del, P26del, A27S, V83A, G142D, Y144del, H146Q, Q183E, V213E, G252V, G339H, R346T, L368I, S371F, S373P, S375F, T376A, D405N, R408S, I410V, K417N, N440K, V445P, G446S, N460K, S477N, T478K, E484A, F486P, F490S, Q498R, N501Y, Y505H, P521S, D614G, H655Y, N679K, P681H, N764K, D796Y, Q954H, N969K (EU.1.1), T19I, L24del, P25del, P26del, A27S, G142D, K147E, W152R, F157L, I210V, V213G, D215G, G257S, G339H, R346T S371F, S373P, S375F, T376A, D405N, R408S, K417N, N440K, K444T, G446S, N460K, L452R, S477N, T478K, E484A, F486S, Q498R, N501Y, Y505H, Q613H, D614G, H655Y, N679K, P681H, N764K, D796Y, Q954H, N969K (FK.1), T19I, P25S, G142D, Y144del, E156G, F157del, R158del, P209L, L212S, D215H, A222V, A243del, L244del, S256L, R346S, S371F, S373P, S375F, T376A, D405N, R408S, K417N, N440K, G446S, L452R, S477N, T478K, E484A, F486P, Q498R, N501Y, Y505H, D614G, H655Y, N679K, P681H, N703I, N764K, D796Y, Q954H, N969K (XBC.1.6), T19I, L24del, P25del, P26del, A27S, Q52H, V83A, G142D, Y144del, H146Q, Q183E, V213E, G252V, G339H, R346T, L368I, S371F, S373P, S375F, T376A, D405N, R408S, K417N, N440K, V445P, G446S, F456L, N460K, S477N, T478K, E484A, F486P, F490S, Q498R, N501Y, Y505H, D614G, H655Y, N679K, P681H, N764K, D796Y, Q954H, N969K (EG.5.1), T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, F456L, N460K, S477N, T478K, E484A, F486P, F490S, Q498R, N501Y, Y505H, D614G, H655Y, N679K, P681H, N764K, D796Y, Q954H, N969K (EG.5/FE.1/XBB.1.18.1.1), T19I, L24del, P25del, P26del, A27S, V83A, G142D, Y144del, H146Q, K182N, Q183E, V213E, D253G, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, P521S, D614G, H655Y, N679K, P681H, N764K, D796Y, Q954H, N969K (XBB.2.3.3), T19I, L24del, P25del, P26del, A27S, V83A, G142D, Y144del, H146Q, Q183E, V213E, D253G, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, P521S, D614G, H655Y, N679K, P681H, N764K, D796Y, Q954H, N969K (XBB.2.4), T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, L518V, D614G, H655Y, N679K, P681H, N764K, D796Y, Q954H, N969K (GB.1), T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, A701V, N764K, D796Y, Q954H, N969K (FL.1/FL.1.3), T19I, L24del, P25del, P26del, A27S, G142D, K147N, M153T, N164K, V213G, H245N, G257D, G339D, G339H, R346T, S371F, S373P, S375F, T376A, D405N, R408S, K417N, N440K, K444R, G446S, N450D, L452M, N460K, S477N, T478K, E484R, F486S, Q498R, N501Y, Y505H, D614G, H655Y, N679K, P681H, N764K, D796Y, Q954H, N969K (FV.1), T19I, L24del, P25del, P26del, A27S, V83A, G142D, E180V, Y144del, H146Q, Q183E, V213E, G252V, G339H, R346T, L368I, S371F, S373P, S375F, T376A, D405N, R408S, K417N, N440K, V445P, G446S, F456L, N460K, S477N, T478R, E484A, F486P, F490S, Q498R, N501Y, Y505H, D614G, H655Y, N679K, P681H, N764K, D796Y, Q954H, N969K (XBB.1.16.6), T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, E554K, D614G, H655Y, N679K, P681H, N764K, D796Y, Q954H, N969K (XBB.1.19.1), T19I, L24del, P25del, P26del, A27S, V83A, G142D, Y144del, H146Q, Q183E, Y200C, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, N764K, D796Y, Q954H, N969K (XBB.1.22.1), T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, Q675H, N764K, D796Y, Q954H, N969K (EL.1), L18F, T19R, R21G, T95I, G142D, W152L, E156G, F157del, R158del, F186L, V213G, D253G, G339D, R346T, S371F, S373P, S375F, T376A, D405N, R408S, K417N, N440K, G446D, S477N, L452R T478K, E484A, F486P, Q498R, N501Y, Y505H, D614G, P621S, H655Y, N679K, P681H, A706V N764K, D796Y, Q954H, N969K, D1153Y, T1117I (XAY-1.1.1), T19I, L24del, P25del, P26del, A27S, V83A, G142D, Y144del, H146Q, Q183E, V213E, G252V, G339H, R346T, K356T, L368I, S371F, S373P, S375F, T376A, D405N, R408S, K417N, N440K, V445P, G446S, N460K, S477N, T478K, E484A, F486P, F490S, Q498R, N501Y, Y505H, T572I, D614G, H655Y, N679K, P681H, N764K, D796Y, Q954H, N969K (XBB.1.5.44).

In embodiments, the composition (e.g. multivalent composition) comprises 2, 3, 4 or 5 RNA species, wherein said RNA species comprise or consist of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 102-112, 171-176, 221-239, 260, 261, 263, 290-302 and, optionally, at least one pharmaceutically acceptable carrier or excipient, wherein each of the 2, 3, 4 or 5 nucleic acid species encode a different SARS-CoV-2 spike protein.

In embodiments, the composition (e.g. multivalent composition) comprises 2, 3, 4 or 5 RNA species, wherein said RNA species comprise or consist of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 127-137, 177-182, 240-258, 303-315 and, optionally, at least one pharmaceutically acceptable carrier or excipient, wherein each of the 2, 3, 4 or 5 nucleic acid species encode a different SARS-CoV-2 spike protein.

In the following, preferred embodiments of a multivalent composition are provided.

In embodiments, the multivalent composition comprises one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 1, wherein the multivalent composition additionally comprises at least 2, 3, 4 further RNA species selected from i) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 102 or 127; and/or ii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 103 or 128; and/or iii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 104 or 129; and/or iv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 105 or 130; and/or v) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 106 or 131; and/or vi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 107 or 132; and/or vii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 108 or 133; and/or viii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 109 or 134; and/or ix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 110 or 135; and/or x) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 111 or 136; and/or xi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 112 or 137; and/or xii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 171 or 177; and/or xiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 172 or 178; and/or xiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 173 or 179; and/or xv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 174 or 180; and/or xvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 175 or 181; and/or xvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 176 or 182; and/or xviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 221 or 240, and/or xix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 222 or 241, and/or xx) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 223 or 242, and/or xxi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 224 or 243, and/or xxii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 225 or 244, and/or xxiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 226 or 245, and/or xxiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 227 or 246, and/or xxv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 228 or 247, and/or xxvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 229 or 248, and/or xxvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 230 or 249, and/or xxviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 231 or 250, and/or xxix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 232 or 251, and/or xxx) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 233 or 252, and/or xxxi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 234 or 253, and/or xxxii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 235 or 254, and/or xxxiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 236 or 255, and/or xxxiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 237 or 256, and/or xxxv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 238 or 257, and/or xxxvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 239 or 258, and/or xxxvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 290 or 303, and/or xxxviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 291 or 304, and/or xxxix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 292 or 305, and/or xxxx) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 293 or 306, and/or xxxxi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 294 or 307, and/or xxxxii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 295 or 308, and/or xxxxiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 296 or 309, and/or xxxxiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 297 or 310, and/or xxxxv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 298 or 311, and/or xxxxvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 299 or 312, and/or xxxxvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 300 or 313, and/or xxxxviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 301 or 314, and/or xxxxix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 302 or 315.

In embodiments, the multivalent composition comprises at least i) one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 45, and ii) one further RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 1.

In embodiments, the multivalent composition comprises at least i) one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 162, and ii) one further RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 1.

In embodiments, the multivalent composition comprises one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 2, wherein the multivalent composition additionally comprises at least 2, 3, 4 further RNA species selected from i) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 102 or 127; and/or ii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 103 or 128; and/or iii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 104 or 129; and/or iv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 105 or 130; and/or v) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 106 or 131; and/or vi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 107 or 132; and/or vii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 108 or 133; and/or viii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 109 or 134; and/or ix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 110 or 135; and/or x) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 111 or 136; and/or xi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 112 or 137; and/or xii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 171 or 177; and/or xiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 172 or 178; and/or xiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 173 or 179; and/or xv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 174 or 180; and/or xvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 175 or 181; and/or xvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 176 or 182; and/or xviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 221 or 240, and/or xix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 222 or 241, and/or xx) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 223 or 242, and/or xxi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 224 or 243, and/or xxii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 225 or 244, and/or xxiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 226 or 245, and/or xxiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 227 or 246, and/or xxv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 228 or 247, and/or xxvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 229 or 248, and/or xxvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 230 or 249, and/or xxviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 231 or 250, and/or xxix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 232 or 251, and/or xxx) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 233 or 252, and/or xxxi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 234 or 253, and/or xxxii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 235 or 254, and/or xxxiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 236 or 255, and/or xxxiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 237 or 256, and/or xxxv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 238 or 257, and/or xxxvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 239 or 258, and/or xxxvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 290 or 303, and/or xxxviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 291 or 304, and/or xxxix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 292 or 305, and/or xxxx) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 293 or 306, and/or xxxxi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 294 or 307, and/or xxxxii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 295 or 308, and/or xxxxiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 296 or 309, and/or xxxxiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 297 or 310, and/or xxxxv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 298 or 311, and/or xxxxvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 299 or 312, and/or xxxxvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 300 or 313, and/or xxxxviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 301 or 314, and/or xxxxix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 302 or 315.

In embodiments, the multivalent composition comprises at least i) one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 45, and ii) one further RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 2.

In embodiments, the multivalent composition comprises at least i) one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 162, and ii) one further RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 2.

In embodiments, the multivalent composition comprises one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 56, wherein the multivalent composition additionally comprises at least 2, 3, 4 further RNA species selected from i) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 102 or 127; and/or ii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 103 or 128; and/or iii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 104 or 129; and/or iv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 105 or 130; and/or v) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 106 or 131; and/or vi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 107 or 132; and/or vii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 108 or 133; and/or viii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 109 or 134; and/or ix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 110 or 135; and/or x) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 111 or 136; and/or xi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 112 or 137; and/or xii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 171 or 177; and/or xiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 172 or 178; and/or xiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 173 or 179; and/or xv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 174 or 180; and/or xvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 175 or 181; and/or xvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 176 or 182; and/or xviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 221 or 240, and/or xix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 222 or 241, and/or xx) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 223 or 242, and/or xxi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 224 or 243, and/or xxii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 225 or 244, and/or xxiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 226 or 245, and/or xxiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 227 or 246, and/or xxv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 228 or 247, and/or xxvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 229 or 248, and/or xxvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 230 or 249, and/or xxviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 231 or 250, and/or xxix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 232 or 251, and/or xxx) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 233 or 252, and/or xxxi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 234 or 253, and/or xxxii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 235 or 254, and/or xxxiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 236 or 255, and/or xxxiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 237 or 256, and/or xxxv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 238 or 257, and/or xxxvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 239 or 258, and/or xxxvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 290 or 303, and/or xxxviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 291 or 304, and/or xxxix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 292 or 305, and/or xxxx) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 293 or 306, and/or xxxxi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 294 or 307, and/or xxxxii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 295 or 308, and/or xxxxiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 296 or 309, and/or xxxxiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 297 or 310, and/or xxxxv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 298 or 311, and/or xxxxvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 299 or 312, and/or xxxxvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 300 or 313, and/or xxxxviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 301 or 314, and/or xxxxix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 302 or 315.

In embodiments, the multivalent composition comprises at least i) one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 45, and ii) one further RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 56.

In embodiments, the multivalent composition comprises at least i) one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 162, and ii) one further RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NO: 56.

In embodiments, the multivalent composition comprises one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 63, wherein the multivalent composition additionally comprises at least 2, 3, 4 further RNA species selected from i) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 102 or 127; and/or ii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 103 or 128; and/or iii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 104 or 129; and/or iv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 105 or 130; and/or v) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 106 or 131; and/or vi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 107 or 132; and/or vii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 108 or 133; and/or viii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 109 or 134; and/or ix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 110 or 135; and/or x) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 111 or 136; and/or xi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 112 or 137; and/or xii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 171 or 177; and/or xiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 172 or 178; and/or xiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 173 or 179; and/or xv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 174 or 180; and/or xvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 175 or 181; and/or xvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 176 or 182; and/or xviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 221 or 240, and/or xix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 222 or 241, and/or xx) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 223 or 242, and/or xxi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 224 or 243, and/or xxii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 225 or 244, and/or xxiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 226 or 245, and/or xxiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 227 or 246, and/or xxv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 228 or 247, and/or xxvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 229 or 248, and/or xxvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 230 or 249, and/or xxviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 231 or 250, and/or xxix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 232 or 251, and/or xxx) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 233 or 252, and/or xxxi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 234 or 253, and/or xxxii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 235 or 254, and/or xxxiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 236 or 255, and/or xxxiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 237 or 256, and/or xxxv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 238 or 257, and/or xxxvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 239 or 258, and/or
xxxvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 290 or 303, and/or
xxxviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 291 or 304, and/or
xxxix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 292 or 305, and/or
xxxx) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 293 or 306, and/or
xxxxi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 294 or 307, and/or
xxxxii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 295 or 308, and/or
xxxxiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 296 or 309, and/or
xxxxiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 297 or 310, and/or
xxxxv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 298 or 311, and/or
xxxxvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 299 or 312, and/or
xxxxvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 300 or 313, and/or
xxxxviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 301 or 314, and/or
xxxxix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 302 or 315.

In embodiments, the multivalent composition comprises one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 66, wherein the multivalent composition additionally comprises at least 2, 3, 4 further RNA species selected from
i) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 102 or 127; and/or
ii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 103 or 128; and/or
iii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 104 or 129; and/or
iv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 105 or 130; and/or
v) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 106 or 131; and/or
vi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 107 or 132; and/or
vii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 108 or 133; and/or
viii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 109 or 134; and/or
ix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 110 or 135; and/or
x) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 111 or 136; and/or
xi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 112 or 137; and/or
xii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 171 or 177; and/or xiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 172 or 178; and/or xiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 173 or 179; and/or xv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 174 or 180; and/or xvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 175 or 181; and/or xvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 176 or 182 and/or xviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 221 or 240, and/or xix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 222 or 241, and/or xx) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 223 or 242, and/or xxi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 224 or 243, and/or xxii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 225 or 244, and/or xxiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 226 or 245, and/or xxiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 227 or 246, and/or xxv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 228 or 247, and/or xxvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 229 or 248, and/or xxvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 230 or 249, and/or xxviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 231 or 250, and/or xxix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 232 or 251, and/or xxx) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 233 or 252, and/or xxxi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 234 or 253, and/or xxxii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 235 or 254, and/or xxxiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 236 or 255, and/or xxxiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 237 or 256, and/or xxxv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 238 or 257, and/or xxxvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 239 or 258, and/or xxxvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 290 or 303, and/or xxxviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 291 or 304, and/or xxxix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 292 or 305, and/or xxxx) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 293 or 306, and/or xxxxi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 294 or 307, and/or xxxxii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 295 or 308, and/or xxxxiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 296 or 309, and/or xxxxiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 297 or 310, and/or xxxxv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 298 or 311, and/or xxxxvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 299 or 312, and/or xxxxvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 300 or 313, and/or xxxxviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 301 or 314, and/or xxxxix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 302 or 315.

In embodiments, the multivalent composition comprises one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 67, wherein the multivalent composition additionally comprises at least 2, 3, 4 further RNA species selected from i) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 102 or 127; and/or ii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 103 or 128; and/or iii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 104 or 129; and/or iv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 105 or 130; and/or v) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 106 or 131; and/or vi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 107 or 132; and/or vii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 108 or 133; and/or viii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 109 or 134; and/or ix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 110 or 135; and/or x) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 111 or 136; and/or xi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 112 or 137; and/or xii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 171 or 177; and/or xiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 172 or 178; and/or xiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 173 or 179; and/or xv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 174 or 180; and/or xvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 175 or 181; and/or xvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 176 or 182; and/or xviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 221 or 240, and/or xix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 222 or 241, and/or xx) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 223 or 242, and/or xxi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 224 or 243, and/or xxii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 225 or 244, and/or xxiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 226 or 245, and/or xxiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 227 or 246, and/or xxv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 228 or 247, and/or xxvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 229 or 248, and/or xxvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 230 or 249, and/or xxviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 231 or 250, and/or xxix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 232 or 251, and/or xxx) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 233 or 252, and/or xxxi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 234 or 253, and/or xxxii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 235 or 254, and/or xxxiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 236 or 255, and/or xxxiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 237 or 256, and/or xxxv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 238 or 257, and/or xxxvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 239 or 258, and/or xxxvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 290 or 303, and/or xxxviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 291 or 304, and/or xxxix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 292 or 305, and/or xxxx) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 293 or 306, and/or xxxxi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 294 or 307, and/or xxxxii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 295 or 308, and/or xxxxiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 296 or 309, and/or xxxxiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 297 or 310, and/or xxxxv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 298 or 311, and/or xxxxvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 299 or 312, and/or xxxxvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 300 or 313, and/or xxxxviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 301 or 314, and/or xxxxix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 302 or 315.

In embodiments, the multivalent composition comprises one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 162, wherein the multivalent composition additionally comprises at least 2, 3, 4 further RNA species selected from i) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 102 or 127; and/or ii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 103 or 128; and/or iii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 104 or 129; and/or iv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 105 or 130; and/or v) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 106 or 131; and/or vi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 107 or 132; and/or vii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 108 or 133; and/or viii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 109 or 134; and/or ix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 110 or 135; and/or x) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 111 or 136; and/or xi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 112 or 137; and/or xii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 171 or 177; and/or xiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 172 or 178; and/or xiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 173 or 179; and/or xv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 175 or 181; and/or xvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 176 or 182; and/or xviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 221 or 240, and/or xix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 222 or 241, and/or xx) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 223 or 242, and/or xxi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 224 or 243, and/or xxii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 225 or 244, and/or xxiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 226 or 245, and/or xxiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 227 or 246, and/or xxv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 228 or 247, and/or xxvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 229 or 248, and/or xxvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 230 or 249, and/or xxviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 231 or 250, and/or xxix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 232 or 251, and/or xxx) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 233 or 252, and/or xxxi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 234 or 253, and/or xxxii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 235 or 254, and/or xxxiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 236 or 255, and/or xxxiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 237 or 256, and/or xxxv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 238 or 257, and/or xxxvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 239 or 258, and/or xxxvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 290 or 303, and/or xxxviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 291 or 304, and/or xxxix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 292 or 305, and/or xxxx) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 293 or 306, and/or xxxxi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 294 or 307, and/or xxxxii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 295 or 308, and/or xxxxiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 296 or 309, and/or xxxxiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 297 or 310, and/or xxxxv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 298 or 311, and/or xxxxvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 299 or 312, and/or xxxxvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 300 or 313, and/or xxxxviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 301 or 314, and/or xxxxix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 302 or 315.

In embodiments, the multivalent composition comprises one RNA species comprising a nucleic acid sequence being identical or at least 95%, 96%, 97%, 98%, or 99% identical to any one of SEQ ID NOs: 152, 153, 154, 155, 156, 157 or 158, wherein the multivalent composition additionally comprises at least 2, 3, 4 further RNA species selected from i) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 102 or 127; and/or ii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 103 or 128; and/or iii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 104 or 129; and/or iv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 105 or 130; and/or v) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 106 or 131; and/or vi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 107 or 132; and/or vii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 108 or 133; and/or viii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 109 or 134; and/or ix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 110 or 135; and/or x) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 111 or 136; and/or xi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 112 or 137; and/or xii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 171 or 177; and/or xiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 172 or 178; and/or xiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 173 or 179; and/or xv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 175 or 181; and/or xvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 176 or 182; and/or xviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 221 or 240, and/or xix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 222 or 241, and/or xx) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 223 or 242, and/or xxi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 224 or 243, and/or xxii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 225 or 244, and/or xxiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 226 or 245, and/or xxiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 227 or 246, and/or xxv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 228 or 247, and/or xxvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 229 or 248, and/or xxvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 230 or 249, and/or xxviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 231 or 250, and/or xxix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 232 or 251, and/or xxx) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 233 or 252, and/or xxxi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 234 or 253, and/or xxxii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 235 or 254, and/or xxxiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 236 or 255, and/or xxxiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 237 or 256, and/or xxxv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 238 or 257, and/or xxxvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 239 or 258, and/or xxxvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 290 or 303, and/or xxxviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 291 or 304, and/or xxxix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 292 or 305, and/or xxxx) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 293 or 306, and/or xxxxi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 294 or 307, and/or xxxxii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 295 or 308, and/or xxxxiii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 296 or 309, and/or xxxxiv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 297 or 310, and/or xxxxv) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 298 or 311, and/or xxxxvi) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 299 or 312, and/or xxxxvii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 300 or 313, and/or xxxxviii) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 301 or 314, and/or xxxxix) one RNA species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 302 or 315.

In preferred embodiments, the composition, such as the multivalent composition is suitable for a vaccine against B.1.1.529 (Omicron), BA.1 (Omicron), BA.2 (Omicron), BA.4 (Omicron), BA.5 (Omicron), B.1.1.7 (Alpha), B.1.351

(Beta), P.1 (Gamma), B.1.617.2 (Delta), C.37 (Lambda), BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44.

In further embodiments, the composition, such as the multivalent composition is suitable for a vaccine against newly emerging SARS-CoV-2 variants.

In embodiments, the RNA as comprised in the composition is provided in an amount of about 100 ng to about 500 µg, in an amount of about 1 µg to about 200 µg, in an amount of about 1 µg to about 100 µg, in an amount of about 5 µg to about 100 µg, preferably in an amount of about 10 µg to about 50 µg, specifically, in an amount of about 1 µg, 2 µg, 3 µg, 4 µg, 5 µg, 6 µg, 7 µg, 8 µg, 9 µg, 10 µg, 11 µg, 12 µg, 13 µg, 14 µg, 15 µg, 20 µg, 25 µg, 30 µg, 35 µg, 40 µg, 45 µg, 50 µg, 55 µg, 60 µg, 65 µg, 70 µg, 75 µg, 80 µg, 85 µg, 90 µg, 95 µg or 100 µg.

In case the composition comprises a plurality or at least more than one of the RNA species as defined herein (multivalent composition), the amount of RNA for each RNA species is provided in an amount of about 100 ng to about 500 µg, in an amount of about 1 µg to about 200 µg, in an amount of about 1 µg to about 100 µg, in an amount of about 5 µg to about 100 µg, preferably in an amount of about 10 µg to about 50 µg, specifically, in an amount of about 1 µg, 2 µg, 3 µg, 4 µg, 5 µg, 6 µg, 7 µg, 8 µg, 9 µg, 10 µg, 11 µg, 12 µg, 13 µg, 14 µg, 15 µg, 20 µg, 25 µg, 30 µg, 35 µg, 40 µg, 45 µg, 50 µg, 55 µg, 60 µg, 65 µg, 70 µg, 75 µg, 80 µg, 85 µg, 90 µg, 95 µg or 100 µg.

In some embodiments, the amount of RNA for each RNA species is essentially equal in mass. In other embodiments, the amount of RNA for each RNA species is selected to be equimolar.

Complexation

In embodiments of the second aspect, the at least one RNA, such as the at least one mRNA, is complexed or associated with further compound to obtain a complexed formulated composition. A complexed formulation may have the function of a transfection agent. A complexed formulated composition may also have the function of protecting the RNA and/or mRNA from degradation.

In embodiments of the second aspect, the at least one RNA, such as the at least one mRNA, and optionally the at least one further RNA, is complexed or associated with, or at least partially complexed or partially associated with one or more cationic or polycationic compound, such as cationic or polycationic polymer, cationic or polycationic polysaccharide, cationic or polycationic lipid, cationic or polycationic protein, cationic or polycationic peptide, or any combinations thereof.

The term "cationic or polycationic compound" as used herein refers to a charged molecule, which is positively charged at a pH value ranging from about 1 to 9, at a pH value ranging from about 3 to 8, at a pH value ranging from about 4 to 8, at a pH value ranging from about 5 to 8, or at a pH value ranging from about 6 to 8, or at a pH value ranging from about 7 to 8, or at a physiological pH, e.g. ranging from about 7.2 to about 7.5. Accordingly, a cationic component, e.g. a cationic peptide, cationic protein, cationic polymer, cationic polysaccharide, cationic lipid may be any positively charged compound or polymer which is positively charged under physiological conditions. A "cationic or polycationic peptide or protein" may contain at least one positively charged amino acid, or more than one positively charged amino acid, e.g. selected from Arg, His, Lys or Orn. Accordingly, "polycationic" components are also within the scope exhibiting more than one positive charge under the given conditions.

The cationic or polycationic compounds, in this context may be selected from the following list of cationic or polycationic peptides or proteins of fragments thereof: protamine, nucleoline, spermine or spermidine, or other cationic peptides or proteins, such as poly-L-lysine (PLL), poly-arginine, basic polypeptides, cell penetrating peptides (CPPs), including HIV-binding peptides, HIV-1 Tat (HIV), Tat-derived peptides, Penetratin, VP22 derived or analog peptides, HSV VP22 (Herpes simplex), MAP, KALA or protein transduction domains (PTDs), PpT620, prolin-rich peptides, arginine-rich peptides, lysine-rich peptides, MPG-peptide(s), Pep-1, L-oligomers, Calcitonin peptide(s), Antennapedia-derived peptides, pAntp, plsl, FGF, Lactoferrin, Transportan, Buforin-2, Bac715-24, SynB, SynB(1), pVEC, hCT-derived peptides, SAP, or histones. In embodiments, the nucleic acid (e.g. DNA or RNA), e.g. the coding RNA, such as the mRNA, is complexed with one or more polycations, such as with protamine or oligofectamine. In embodiments, the nucleic acid (e.g. DNA or RNA), e.g. the coding RNA, such as the mRNA, is complexed with protamine.

Further cationic or polycationic compounds, which can be used as transfection or complexation agent may include cationic polysaccharides, for example chitosan, polybrene etc.; cationic lipids, e.g. DOTMA, DMRIE, di-C14-amidine, DOTIM, SAINT, DC-Chol, BGTC, CTAP, DOPC, DODAP, DOPE: Dioleyl phosphatidylethanol-amine, DOSPA, DODAB, DOIC, DMEPC, DOGS, DIMRI, DOTAP, DC-6-14, CLIP1, CLIP6, CLIP9, oligofectamine; or cationic or polycationic polymers, e.g. modified polyaminoacids, such as beta-aminoacid-polymers or reversed polyamides, etc., modified polyethylenes, such as PVP etc., modified acrylates, such as pDMAEMA etc., modified amidoamines such as pAMAM etc., modified polybetaaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI, poly(propyleneimine), etc., polyallylamine, sugar backbone based polymers, such as cyclodextrin based polymers, dextran based polymers, etc., silan backbone based polymers, such as PMOXA-PDMS copolymers, etc., blockpolymers consisting of a combination of one or more cationic blocks (e.g. selected from a cationic polymer as mentioned above) and of one or more hydrophilic or hydrophobic blocks (e.g. polyethyleneglycole); etc.

According to various embodiments, the composition of the present invention comprises at least one RNA, such as at least one mRNA as defined in the context of the first aspect, and a polymeric carrier.

The term "polymeric carrier" as used herein refers to a compound that facilitates transport and/or complexation of another compound (e.g. cargo nucleic acid). A polymeric carrier is typically a carrier that is formed of a polymer. A polymeric carrier may be associated to its cargo (e.g. DNA, or RNA) by covalent or non-covalent interaction. A polymer may be based on different subunits, such as a copolymer.

Suitable polymeric carriers in that context may include, for example, polyacrylates, polyalkycyanoacrylates, polylactide, polylactide-polyglycolide copolymers, polycaprolactones, dextran, albumin, gelatin, alginate, collagen, chitosan, cyclodextrins, protamine, PEGylated protamine, PEGylated PLL and polyethylenimine (PEI), dithiobis(succinimidylpropionate) (DSP), Dimethyl-3,3'-dithiobispropionimidate (DTBP), poly(ethylene imine) biscarbamate (PEIC), poly(L-lysine) (PLL), histidine modified PLL, poly(N-vinylpyrrolidone) (PVP), poly(propylenimine) (PPI), poly(amidoamine) (PAMAM), poly(amido ethylenimine) (SS-PAEI), triehtylenetetramine (TETA), poly(β-aminoester), poly(4-hydroxy-L-proine ester) (PHP), poly(allylamine), poly(α-[4-aminobutyl]-L-glycolic acid (PAGA), Poly(D,L-lactic-co-glycolid acid (PLGA), Poly(N-ethyl-4-vinylpyridinium bromide), poly(phosphazene)s (PPZ), poly(phosphoester)s (PPE), poly(phosphoramidate)s (PPA), poly(N-2-hydroxypropylmethacrylamide) (pHPMA), poly(2-(dimethylamino)ethyl methacrylate) (pDMAEMA), poly(2-aminoethyl propylene phosphate) PPE_EA), galactosylated chitosan, N-dodecylated chitosan, histone, collagen and dextran-spermine. In one embodiment, the polymer may be an inert polymer such as, but not limited to, PEG. In one embodiment, the polymer may be a cationic polymer such as, but not limited to, PEI, PLL, TETA, poly(allylamine), Poly(N-ethyl-4-vinylpyridinium bromide), pHPMA and pDMAEMA. In one embodiment, the polymer may be a biodegradable PEI such as, but not limited to, DSP, DTBP and PEIC. In one embodiment, the polymer may be biodegradable such as, but not limited to, histine modified PLL, SS-PAEI, poly(β-aminoester), PHP, PAGA, PLGA, PPZ, PPE, PPA and PPE-EA.

Formulation in Lipid-Based Carriers (Encapsulation/Complexation in LNPs)

In preferred embodiments of the second aspect, the at least one RNA, such as the at least one mRNA, and optionally the at least one further RNA, is complexed, encapsulated, partially encapsulated, or associated with one or more lipids (e.g. ionizable lipids and/or neutral lipids), thereby forming lipid-based carriers such as liposomes, lipid nanoparticles (LNPs), lipoplexes, and/or nanoliposomes. In further very preferred embodiments, the at least one RNA of the invention as disclosed herein is encapsulated in lipid-based carriers.

In the context of the invention, a "lipid-based carrier" is selected from liposomes, lipid nanoparticles (LNPs), lipoplexes, and/or nanoliposomes. The at least one RNA of the invention as disclosed herein may completely or partially incorporated or encapsulated in a lipid-based carrier, wherein the RNA may be located in the interior space of the lipid-based carrier, within the lipid layer/membrane of the lipid-based carrier, or associated with the exterior surface of the lipid-based carrier. The incorporation of an RNA into lipid-based carriers is also referred to as "encapsulation". A "lipid-based carrier" is not restricted to any particular morphology, and include any morphology generated when lipids are combined in an aqueous environment in the presence of an RNA. For example, an LNP, a liposome, a lipid complex, a lipoplex and the like are within the scope of the term "lipid-based carrier". Lipid-based carriers can be of different sizes such as, but not limited to, a multilamellar vesicle (MLV) which may be hundreds of nanometers in diameter and may contain a series of concentric bilayers separated by narrow aqueous compartments, a small unicellular vesicle (SUV) which may be smaller than 50 nm in diameter, and a large unilamellar vesicle (LUV) which may be between 50 nm and 500 nm in diameter. Liposomes, a specific type of lipid-based carrier, are characterized as microscopic vesicles having an interior aqua space sequestered from an outer medium by a membrane of one or more bilayers. In a liposome, the RNA is typically located in the interior aqueous space enveloped by some or the entire lipid portion of the liposome. Bilayer membranes of liposomes are typically formed by amphiphilic molecules, such as lipids of synthetic or natural origin that comprise spatially separated hydrophilic and hydrophobic domains. Lipid nanoparticles (LNPs), a specific type of lipid-based carrier, are characterized as microscopic lipid particles having a solid core or partially solid core. Typically, an LNP does not comprise an interior aqua space sequestered from an outer medium by a bilayer. In an LNP, the RNA may be encapsulated or incorporated in the lipid portion of the LNP enveloped by some or the entire lipid portion of the LNP. An LNP may comprise any lipid capable of forming a particle to which the RNA may be attached, or in which the RNA may be encapsulated.

The term "encapsulated", e.g. incorporated, complexed, encapsulated, partially encapsulated, associated, partially associated, refers to the essentially stable combination of RNA with one or more lipids into lipid-based carriers (e.g. larger complexes or assemblies) without covalent binding of the RNA. The lipid-based carriers—encapsulated RNA may be completely or partially located in the interior of the lipid-based carrier (e.g. the lipid portion and/or an interior space) and/or within the lipid layer/membrane of the lipid-based carriers. The encapsulation of an RNA into lipid-based carriers is also referred to herein as "incorporation" as the RNA is preferably contained within the interior of the lipid-based carriers. Without wishing to be bound to theory, the purpose of incorporating or encapsulating RNA into lipid-based carriers may be to protect the RNA from an environment which may contain enzymes, chemicals, or conditions that degrade the RNA. Moreover, incorporating RNA into lipid-based carriers may promote the uptake of the RNA, and hence, may enhance the therapeutic effect of the RNA when administered to a cell or a subject.

In various embodiments, the RNA of the invention as disclosed herein does not exceed a certain proportion of free RNA. In some embodiments, the vaccine of the invention as disclosed herein comprises less than about 20% free RNA, preferably less than about 15% free RNA, more preferably less than about 10% free RNA, most preferably less than about 5% free RNA. In various embodiments, about 70% to about 100% of the RNA in the vaccine of the invention as disclosed herein is encapsulated in the lipid-based carriers. In some embodiments, the vaccine of the invention as disclosed herein comprises about 80% encapsulated RNA (and about 20% free RNA), about 85% encapsulated RNA (and about 15% free RNA), about 90% encapsulated RNA (and about 10% free RNA), or about 95% encapsulated RNA (and 5% about free RNA). The term "encapsulated RNA" comprises the RNA molecules that are encapsulated in the lipid-based carriers as defined herein. The proportion of encapsulated RNA in the context of the invention is typically determined using a RiboGreen assay.

The term "free RNA" or "non-complexed RNA" or "non-encapsulated RNA" comprises the RNA molecules that are not formulated, e.g. encapsulated in a lipid-based carrier. During formulation of the vaccine, free RNA may represent a contamination or an impurity. A large proportion of non-encapsulated or free RNA may also be an indicator for destabilization of the formulation, e.g. destabilization of lipid-based carriers. The skilled person can choose from a variety of different methods for determining the amount and/or the proportion of free RNA in the vaccine. Free RNA may be determined by chromatographic methods (e.g. AEX, SEC) or by using probes (e.g. dyes) that bind to free RNA in the vaccine. In the context of the invention, the amount of free RNA or non-encapsulated RNA may be determined using a dye based assay. Suitable dyes that may be used to determine the amount and/or the proportion of free RNA comprise RiboGreen®, PicoGreen® dye, OliGreen® dye, QuantiFluor® RNA dye, Qubit® RNA dye, Quant-iT™ RNA dye, TOTO®-1 dye, YOYO®-1 dye. Such dyes are suitable to discriminate between free RNA and encapsulated RNA. Reference standards consisting of defined amounts of free RNA or encapsulated RNA may be used and mixed with the respective reagent (e.g. RiboGreen® reagent (Excitation 500 nm/Emission 525 nm)) as recommended by the supplier's instructions. Typically, the free RNA is quantitated using the Quant-iT RiboGreen RNA Reagent according to the manufacturer's instructions. The proportion of free RNA is typically determined using a RiboGreen assay.

The liposomes, lipid nanoparticles (LNPs), lipoplexes, and/or nanoliposomes—incorporated RNA may be completely or partially located in the interior space of the liposomes, lipid nanoparticles (LNPs), lipoplexes, and/or nanoliposomes, within the lipid layer/membrane, or associated with the exterior surface of the lipid layer/membrane.

The incorporation of RNA into liposomes/LNPs is also referred to herein as "encapsulation" wherein the RNA is entirely contained within the interior space of the liposomes, lipid nanoparticles (LNPs), lipoplexes, and/or nanoliposomes. The purpose of incorporating RNA into liposomes, lipid nanoparticles (LNPs), lipoplexes, and/or nanoliposomes is to protect the RNA from an environment which may contain enzymes or chemicals or conditions that degrade nucleic acid and/or systems or receptors that cause the rapid excretion of the nucleic acid. Moreover, incorporating RNA into liposomes, lipid nanoparticles (LNPs), lipoplexes, and/or nanoliposomes may promote the uptake of the RNA, and hence, may enhance the therapeutic effect of the RNA encoding antigenic SARS-CoV-2 spike proteins. Accordingly, incorporating the at least one RNA into liposomes, lipid nanoparticles (LNPs), lipoplexes, and/or nanoliposomes may be particularly suitable for a SARS-CoV-2 vaccine, e.g. for intramuscular and/or intradermal administration.

In this context, the terms "complexed" or "associated" refer to the essentially stable combination of RNA with one or more lipids into larger complexes or assemblies without covalent binding.

The term "lipid nanoparticle", also referred to as "LNP", is not restricted to any particular morphology, and include any morphology generated when an ionizable cationic lipid and optionally one or more further lipids are combined, e.g. in an aqueous environment and/or in the presence of an RNA. For example, a liposome, a lipid complex, a lipoplex and the like are within the scope of a lipid nanoparticle (LNP). Liposomes, lipid nanoparticles (LNPs), lipoplexes, and/or nanoliposomes can be of different sizes such as, but not limited to, a multilamellar vesicle (MLV) which may be hundreds of nanometers in diameter and may contain a series of concentric bilayers separated by narrow aqueous compartments, a small unicellular vesicle (SUV) which may be smaller than 50 nm in diameter, and a large unilamellar vesicle (LUV) which may be between 50 nm and 500 nm in diameter.

LNPs of the invention are suitably characterized as microscopic vesicles having an interior aqua space sequestered from an outer medium by a membrane of one or more bilayers. Bilayer membranes of LNPs are typically formed by amphiphilic molecules, such as lipids of synthetic or natural origin that comprise spatially separated hydrophilic and hydrophobic domains. Bilayer membranes of the liposomes can also be formed by amphophilic polymers and surfactants (e.g., polymerosomes, niosomes, etc.). In the context of the present invention, an LNP typically serves to transport the at least one RNA to a target tissue.

Accordingly, in preferred embodiments of the second aspect, the at least one RNA is complexed with one or more lipids thereby forming lipid nanoparticles (LNP). Preferably, said LNP is particularly suitable for intramuscular and/or intradermal administration. LNPs typically comprise an ionizable cationic lipid and one or more excipients selected from neutral lipids, charged lipids, steroids and polymer conjugated lipids (e.g. PEGylated lipid). The at least one RNA may be encapsulated in the lipid portion of the LNP or an aqueous space enveloped by some or the entire lipid portion of the LNP. The RNA or a portion thereof may also be associated and complexed with the LNP. An LNP may comprise any lipid capable of forming a particle to which the RNA are attached, or in which the one or more RNA species are encapsulated. Preferably, the LNP comprising RNA comprises one or more ionizable cationic lipids, and one or more stabilizing lipids. Stabilizing lipids include neutral lipids and PEGylated lipids.

The term "phospholipid" or "neutral lipid" as used herein, are lipids that include a phosphate moiety and one or more carbon chains, such as unsaturated fatty acid chains. A neutral or phospholipid may include one or more multiple (e.g., double or triple) bonds (e.g., one or more unsaturations). Particular phospholipids may facilitate fusion to a membrane. For example, a cationic phospholipid may interact with one or more negatively charged phospholipids of a membrane (e.g., a cellular or intracellular membrane). Fusion of a phospholipid to a membrane may allow one or more elements of a lipid-containing composition to pass through the membrane permitting, e.g., delivery of the one or more elements to a cell.

In embodiments, the LNP of the invention comprises (i) at least one ionizable lipid;

(ii) at least one neutral lipid;

(iii) at least one steroid or steroid analogue, preferably cholesterol; and (iv) at least one polymer conjugated lipid, preferably a PEG-lipid;

wherein (i) to (iv) are in a molar ratio of about 20-60% ionizable cationic lipid, 5-25% neutral lipid, 25-55% sterol, and 0.5-15% polymer conjugated lipid.

In the context of lipid nanoparticles, the term "cationic lipid" is used herein and throughout the whole specification interchangeably with "ionizable lipid" or "ionizable cationic lipid". Thus, the cationic lipid of an LNP in embodiments may be cationisable or respectively ionizable, i.e. it becomes protonated as the pH is lowered below the pK of the ionizable group of the lipid, but is progressively more neutral at higher pH values. At pH values below the pK, the lipid is then able to associate with negatively charged nucleic acids. In certain embodiments, the cationic lipid comprises a zwitterionic lipid that assumes a positive charge on pH decrease.

Such lipids include, but are not limited to, DSDMA, N,N-dioleyl-N,N-dimethylammonium chloride (DODAC), N,N-distearyl-N,N-dimethylammonium bromide (DDAB), 1,2-dioleoyltrimethyl ammonium propane chloride (DOTAP) (also known as N-(2,3-dioleoyloxy)propyl)-N,N,N-trimethylammonium chloride and 1,2-Dioleyloxy-3-trimethylaminopropane chloride salt), N-(1-(2,3-dioleyloxy) propyl)-N,N,N-trimethylammonium chloride (DOTMA), N,N-dimethyl-2,3-dioleyloxy)propylamine (DODMA), ckk-E12, ckk, 1,2-DiLinoleyloxy-N,N-dimethylaminopropane (DLinDMA), 1,2-Dilinolenyloxy-N,N-dimethylaminopropane (DLenDMA), 1,2-di-γ-linolenyloxy-N,N-dimethylaminopropane (γ-DLenDMA), 98N12-5, 1,2-Dilinoleylcarbamoyloxy-3-dimethylaminopropane (DLin-C-DAP), 1,2-Dilinoleyoxy-3-(dimethylamino)acetoxypropane (DLin-DAC), 1,2-Dilinoleyoxy-3-morpholinopropane (DLin-MA), 1,2-Dilinoleoyl-3-dimethylaminopropane (DLinDAP), 1,2-Dilinoleylthio-3-dimethylaminopropane (DLin-S-DMA), 1-Linoleoyl-2-linoleyloxy-3-dimethylaminopropane (DLin-2-DMAP), 1,2-Dilinoleyloxy-3-trimethylaminopropane chloride salt (DLin-TMA.Cl), ICE (Imidazol-based), HGT5000, HGT500I, DMDMA, CLinDMA, CpLinDMA, DMOBA, DOcarbDAP, DLincarbDAP, DLinCDAP, KLin-K-DMA, DLin-K-XTC2-DMA, XTC (2,2-Dilinoleyl-4-dimethylaminoethyl-[1,3]-dioxolane) HGT4003, 1,2-Dilinoleoyl-3-trimethylaminopropane chloride salt (DLin-TAP.Cl), 1,2-Dilinoleyloxy-3-(N-methylpiperazino)propane (DLin-MPZ), or 3-(N,N-Dilinoleylamino)-1,2-propanediol (DLinAP), 3-(N,N-Dioleylamino)-1,2-propanedio (DOAP), 1,2-Dilinoleyloxo-3-(2-N,N-dimethylamino)ethoxypropane (DLin-EG-DMA), 2,2-Dilinoleyl-4-dimethylaminomethyl-[1,3]-dioxolane (DLin-K-DMA) or analogs thereof, (3aR,5s,6aS)—N,N-dimethyl-2,2-di((9Z,12Z)-octadeca-9,12-dienyl)tetrahydro-3aH-cyclopenta[d][1,3]dioxol-5-amine, (6Z,9Z,28Z,31Z)-heptatriaconta-6,9,28,31-tetraen-19-yl-4-(dimethylamino)butanoate (MC3), ALNY-100 ((3aR,5s,6aS)—N,N-dimethyl-2,2-di((9Z,12Z)-octadeca-9,12-dienyl)tetrahydro-3aH-cyclopenta[d][1,3]dioxol-5-amine)), 1,1'-(2-(4-(2-((2-(bis(2-hydroxydodecyl)amino)ethyl)(2-hydroxydodecyl)amino)ethyl)piperazin-1-yl)ethylazanediyl)didodecan-2-ol (C12-200), 2,2-dilinoleyl-4-(2-dimethylaminoethyl)-[1,3]-dioxolane (DLin-K-C2-DMA), 2,2-dilinoleyl-4-dimethylaminomethyl-[1,3]-dioxolane (DLin-K-DMA), NC98-5 (4,7,13-tris(3-oxo-3-(undecylamino)propyl)-N1,N16-diundecyl-4,7,10,13-tetraazahexadecane-1,16-diamide), (6Z,9Z,28Z,31Z)-heptatriaconta-6,9,28,31-tetraen-19-yl 4-(dimethylamino) butanoate (DLin-M-C3-DMA), 3-((6Z,9Z,28Z,31Z)-heptatriaconta-6,9,28,31-tetraen-19-yloxy)-N,N-dimethylpropan-1-amine (MC3 Ether), 4-((6Z,9Z,28Z,31Z)-heptatriaconta-6,9,28,31-tetraen-19-yloxy)-N,N-dimethylbutan-1-amine (MC4 Ether), LIPOFECTIN® (commercially available cationic liposomes comprising DOTMA and 1,2-dioleoyl-sn-3phosphoethanolamine (DOPE), from GIBCO/BRL, Grand Island, N.Y.); LIPOFECTAMINE® (commercially available cationic liposomes comprising N-(1-(2,3dioleyloxy)propyl)-N-(2-(sperminecarboxamido)ethyl)-N,N-dimethylammonium trifluoroacetate (DOSPA) and (DOPE), from GIBCO/BRL); and TRANSFECTAM® (commercially available cationic lipids comprising dioctadecylamidoglycyl carboxyspermine (DOGS) in ethanol from Promega Corp., Madison, Wis.) or any combination of any of the foregoing. Further suitable cationic lipids for use in the compositions and methods of the invention include those described in international patent publications WO2010/053572 (and particularly, C12-200 described at paragraph [00225]) and WO2012/170930, both of which are incorporated herein by reference, HGT4003, HGT5000, HGTS001, HGT500I, HGT5002 (see US2015/0140070A1).

In embodiments, the cationic lipid may be an amino lipid.

Representative amino lipids include, but are not limited to, 1,2-dilinoleyoxy-3-(dimethylamino)acetoxypropane (DLin-DAC), 1,2-dilinoleyoxy-3morpholinopropane (DLin-MA), 1,2-dilinoleoyl-3-dimethylaminopropane (DLinDAP), 1,2-dilinoleylthio-3-dimethylaminopropane (DLin-S-DMA), 1-linoleoyl-2-linoleyloxy-3dimethylaminopropane (DLin-2-DMAP), 1,2-dilinoleyloxy-3-trimethylaminopropane chloride salt (DLin-TMA.Cl), 1,2-dilinoleoyl-3-trimethylaminopropane chloride salt (DLin-TAP.Cl), 1,2-dilinoleyloxy-3-(N-methylpiperazino)propane (DLin-MPZ), 3-(N,Ndilinoleylamino)-1,2-propanediol (DLinAP), 3-(N,N-dioleylamino)-1,2-propanediol (DOAP), 1,2-dilinoleyloxo-3-(2-N,N-dimethylamino)ethoxypropane (DLin-EG-DMA), and 2,2-dilinoleyl-4-dimethylaminomethyl-[1,3]-dioxolane (DLin-K-DMA), 2,2-dilinoleyl-4-(2-dimethylaminoethyl)-[1,3]-dioxolane (DLin-KC2-DMA); dilinoleyl-methyl-4-dimethylaminobutyrate (DLin-MC3-DMA); MC3 (US20100324120).

In embodiments, the cationic or ionizable lipid may an aminoalcohol lipidoid.

Aminoalcohol lipidoids which may be used in the present invention may be prepared by the methods described in U.S. Pat. No. 8,450,298, herein incorporated by reference in its entirety. Suitable (ionizable) lipids can also be the compounds as disclosed in Tables 1, 2 and 3 and as defined in claims 1-24 of WO2017/075531A1, hereby incorporated by reference.

In another embodiment, suitable lipids can also be the compounds as disclosed in WO2015/074085A1 (i.e. ATX-001 to ATX-032 or the compounds as specified in claims 1-26), U.S. Appl. No. 61/905,724 and Ser. No. 15/614,499 or U.S. Pat. Nos. 9,593,077 and 9,567,296 hereby incorporated by reference in their entirety.

In other embodiments, suitable cationic ionizable lipids can also be the compounds as disclosed in WO2017/117530A1 (i.e. lipids 13, 14, 15, 16, 17, 18, 19, 20, or the compounds as specified in the claims), hereby incorporated by reference in its entirety.

In embodiments, ionizable or cationic lipids may also be selected from the lipids disclosed in WO2018/078053A1 (i.e. lipids derived from formula I, II, and III of WO2018/078053A1, or lipids as specified in Claims 1 to 12 of WO2018/078053A1), the disclosure of WO2018/078053A1 hereby incorporated by reference in its entirety. In that context, lipids disclosed in Table 7 of WO2018/078053A1 (e.g. lipids derived from formula I-1 to I-41) and lipids disclosed in Table 8 of WO2018/078053A1 (e.g. lipids derived from formula II-1 to II-36) may be suitably used in the context of the invention. Accordingly, formula I-1 to formula I-41 and formula II-1 to formula II-36 of WO2018/078053A1, and the specific disclosure relating thereto, are herewith incorporated by reference.

In embodiments, cationic or ionizable lipids may be derived from formula III of published PCT patent application WO2018/078053A1. Accordingly, formula III of WO2018/078053A1, and the specific disclosure relating thereto, are herewith incorporated by reference.

In preferred embodiments, the at least one RNA, such as the at least one mRNA of the composition is complexed with one or more lipids thereby forming LNPs, wherein the ionizable lipid of the LNP is selected from structures III-1 to III-36 of Table 9 of published PCT patent application WO2018/078053A1. Accordingly, formula III-1 to III-36 of WO2018/078053A1, and the specific disclosure relating thereto, are herewith incorporated by reference.

In particularly preferred embodiment of the second aspect, the at least one RNA, preferably the at least one mRNA is complexed with one or more lipids thereby forming LNPs, wherein the LNPs comprises an ionizable lipid according to formula III-3:

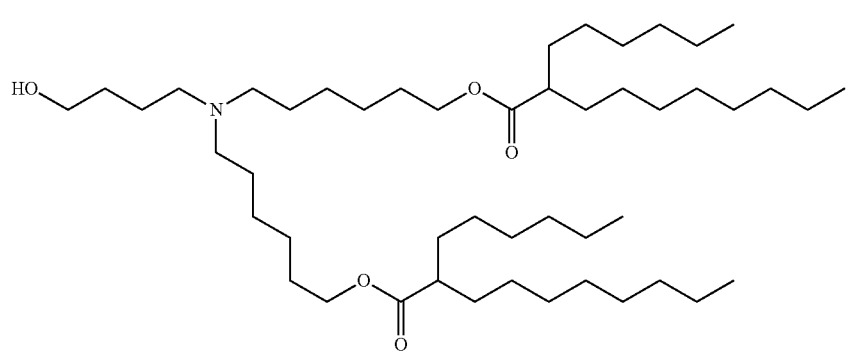

(III-3)

The lipid of formula III-3 as suitably used herein has the chemical term ((4-hydroxybutyl)azanediyl)bis(hexane-6,1-diyl)bis(2-hexyldecanoate), also referred to as ALC-0315.

In certain embodiments, the ionizable cationic lipid as defined herein, more preferably ionizable cationic lipid compound III-3, is present in the LNP in an amount from about 30 to about 95 mole percent, relative to the total lipid content of the LNP. If more than one ionizable cationic lipid is incorporated within the LNP, such percentages apply to the combined ionizable cationic lipids.

In embodiments, the ionizable cationic lipid is present in the LNP in an amount from about 30 to about 70 mole percent. In one embodiment, the ionizable cationic lipid is present in the LNP in an amount from about 40 to about 60 mole percent, such as about 40, 41, 42, 43, 44, 45, 46, 47, 48, 49, 50, 51, 52, 53, 54, 55, 56, 57, 58, 59 or 60 mole percent, respectively. In embodiments, the ionizable cationic lipid is present in the LNP in an amount from about 47 to about 48 mole percent, such as about 47.0, 47.1, 47.2, 47.3, 47.4, 47.5, 47.6, 47.7, 47.8, 47.9, 50.0 mole percent, respectively, wherein 47.7 mole percent are particularly preferred.

In further preferred embodiment of the second aspect, the at least one RNA, preferably the at least one mRNA is complexed with one or more lipids thereby forming LNPs, wherein the LNPs comprises an ionizable cationic lipid according to formula X-1:

The lipid of formula X-1 as suitably used herein has the chemical term (9-Heptadecanyl 8-{(2-hydroxyethyl)[6-oxo-6-(undecyloxy)hexyl]amino}octanoate) or "Heptadecan-9-yl 8-((2-hydroxyethyl)(6-oxo-6-(undecyloxy)hexyl)amino) octanoate", also referred to as SM-102.

In certain embodiments, the ionizable cationic lipid as defined herein, more preferably ionizable cationic lipid compound X-1, is present in the LNP in an amount from about 30 to about 95 mole percent, relative to the total lipid content of the LNP. If more than one ionizable cationic lipid is incorporated within the LNP, such percentages apply to the combined ionizable cationic lipids.

In embodiments, the ionizable cationic lipid is present in the LNP in an amount from about 30 to about 70 mole percent. In one embodiment, the ionizable cationic lipid is present in the LNP in an amount from about 40 to about 60 mole percent, such as from about 45 to about 55 mole percent or about 47 to about 50 mole percent. In embodiments, the ionizable cationic lipid is present in the LNP in an amount from about 48 to about 49 mole percent, such as about 48.0, 48.1, 48.2, 48.3, 48.4, 48.5, 48.6, 48.7, 48.8, 48.9, 49.0 mole percent, respectively, wherein 48.5 mole percent are preferred.

In other embodiments, the lipid-based carriers (e.g. LNPs) of the pharmaceutical composition comprise an ionizable cationic lipid selected or derived from HEXA-C5DE-PipSS (see C2 in Table 1 of WO2021123332). In other embodiments, the lipid-based carriers (e.g. LNPs) of the pharmaceutical composition comprise an ionizable cationic lipid selected or derived from compound C26 as disclosed in Table 1 of WO2021123332:

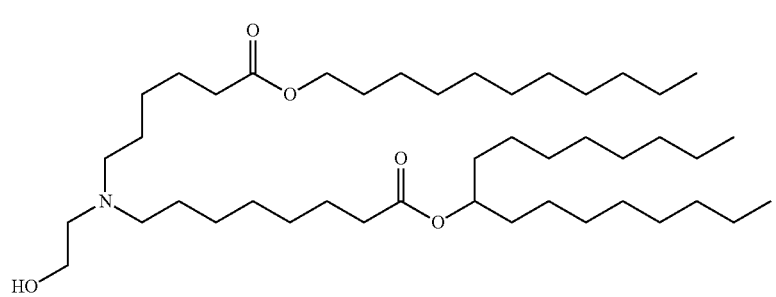

(X-1)

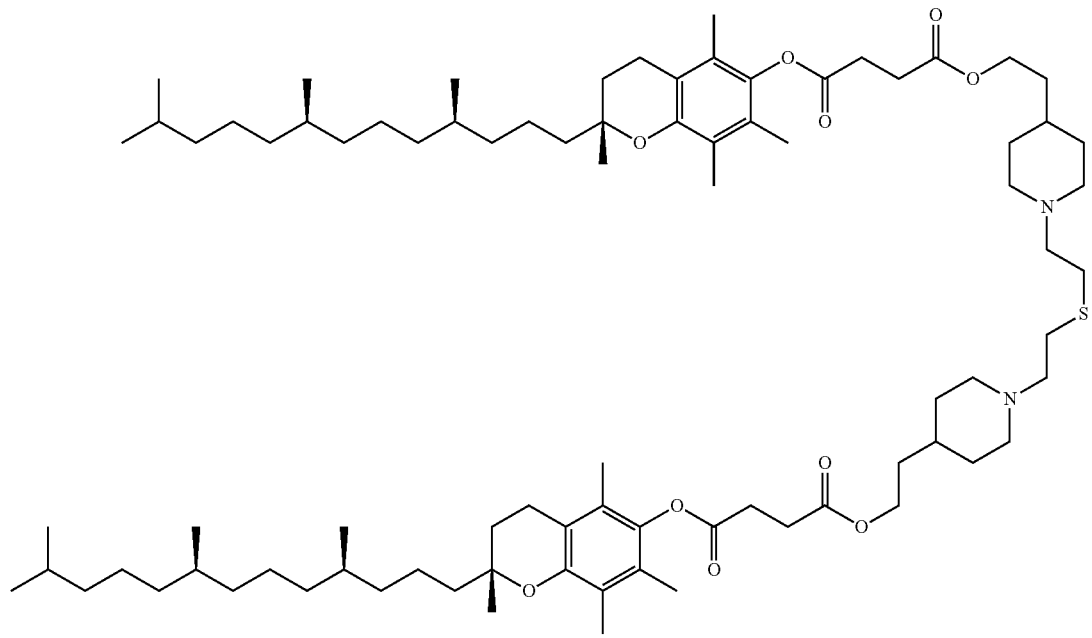 [SMILES: Cc1c(C)c2c(c(C)c1OC(=O)CCC(=O)OCCC1CCN(CCSCCN3CCC(CCOC(=O)CCC(=O)Oc4c(C)c(C)c5c(c4C)CC[C@@](C)(CCC[C@H](C)CCC[C@H](C)CCCC(C)C)O5)CC3)CC1)CC[C@@](C)(CCC[C@H](C)CCC[C@H](C)CCCC(C)C)O2]

Other lipid-based carriers (e.g. LNPs) of the pharmaceutical composition comprise a squaramide ionizable amino lipid, such as an ionizable cationic lipid selected from the group consisting of formulas (M1) and (M2):

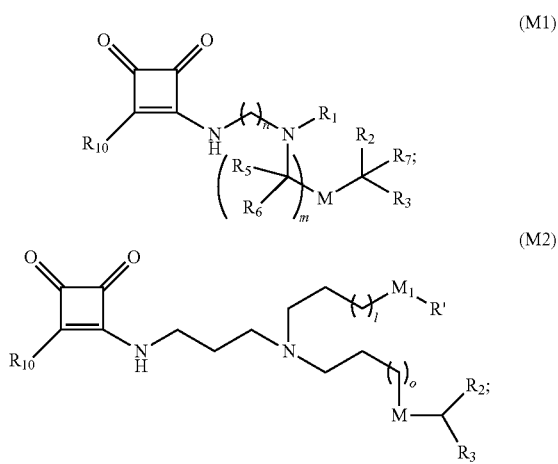

wherein the substituents (e.g. $R_1$, $R_2$, $R_3$, $R_5$, $R_6$, $R_7$, $R_{10}$, M, $M_1$, m, n, o, l) are defined in claims 1 to 13 of U.S. Ser. No. 10/392,341B32; U.S. Ser. No. 10/392,341 B2 being incorporated herein in its entirety.

Accordingly, in other embodiments, the lipid-based carriers (e.g. LNPs) of the pharmaceutical composition comprise an ionizable lipid selected or derived from above mentioned ALC-0315, SM-102, SS-33/4PE-15, HEXA-C5DE-PipSS, or compound C26 (see C26 in Table 1 of WO2021123332).

Other suitable cationic or ionizable, neutral, steroid/sterol or aggregation reducing lipids are disclosed in WO2010053572, WO2011068810, WO2012170889, WO2012170930, WO2013052523, WO2013090648, WO2013149140, WO2013149141, WO2013151663, WO2013151664, WO2013151665, WO2013151666, WO2013151667, WO2013151668, WO2013151669, WO2013151670, WO2013151671, WO2013151672, WO2013151736, WO2013185069, WO2014081507, WO2014089486, WO2014093924, WO2014144196, WO2014152211, WO2014152774, WO2014152940, WO2014159813, WO2014164253, WO2015061461, WO2015061467, WO2015061500, WO2015074085, WO2015105926, WO2015148247, WO2015164674, WO2015184256, WO2015199952, WO2015200465, WO2016004318, WO2016022914, WO2016036902, WO2016081029, WO2016118724, WO2016118725, WO2016176330, WO2017004143, WO2017019935, WO2017023817, WO2017031232, WO2017049074, WO2017049245, WO2017070601, WO2017070613, WO2017070616, WO2017070618, WO2017070620, WO2017070622, WO2017070623, WO2017070624, WO2017070626, WO2017075038, WO2017075531, WO2017099823, WO2017106799, WO2017112865, WO2017117528, WO2017117530, WO2017180917, WO2017201325, WO2017201340, WO2017201350, WO2017201352, WO2017218704, WO2017223135, WO2018013525, WO2018081480, WO2018081638, WO2018089540, WO2018089790, WO2018089801, WO2018089851, WO2018107026, WO2018118102, WO2018119163, WO2018157009, WO2018165257, WO2018170245, WO2018170306, WO2018170322, WO2018170336, WO2018183901, WO2018187590, WO2018191657, WO2018191719, WO2018200943, WO2018231709, WO2018231990, WO2018232120, WO2018232357, WO2019036000, WO2019036008, WO2019036028, WO2019036030, WO2019040590, WO2019089818, WO2019089828, WO2019140102, WO2019152557, WO2019152802, WO2019191780, WO2019222277, WO2019222424, WO2019226650, WO2019226925, WO2019232095, WO2019232097, WO2019232103, WO2019232208, WO2020061284, WO2020061295, WO2020061332, WO2020061367, WO2020081938, WO2020097376, WO2020097379, WO2020097384, WO2020102172, WO2020106903, WO2020146805, WO2020214946, WO2020219427, WO2020227085, WO2020232276, WO2020243540, WO2020257611, WO2020257716, WO2021007278, WO2021016430, WO2021022173, WO2021026358, WO2021030701, WO2021046260, WO2021050986, WO2021055833, WO2021055835, WO2021055849, WO2021127394, WO2021127641, WO2021202694, WO2021231697, WO2021231901, WO2008103276, WO2009086558, WO2009127060, WO2010048536, WO2010054406, WO2010080724, WO2010088537, WO2010129709, WO201021865, WO2011022460, WO2011043913, WO2011090965, WO2011149733, WO2011153120, WO2011153493, WO2012040184, WO2012044638, WO2012054365, WO2012061259, WO2013063468, WO2013086354, WO2013086373, U.S. Pat. No. 7,893,302B2, U.S. Pat. No. 7,404,969B2, U.S. Pat. No. 8,158,601 B2, U.S. Pat. No. 8,283,333B2, U.S. Pat. No. 8,466,122B2, U.S. Pat. No. 8,569,256B2, US20100036115, US20110256175, US20120202871, US20120027803, US20120128760, US20130064894, US20130129785, US20130150625, US20130178541, US20130225836, and US20140039032; the disclosures specifically relating to cationic or ionizable, neutral, sterol or aggregation reducing lipids suitable for lipid-based carriers of the foregoing publications are incorporated herewith by reference.

In some embodiments, the ionizable cationic lipid is present in a ratio of from about 20 mol % to about 70 or 75 mol % or from about 45 to about 65 mol % or about 20, 25, 30, 35, 40, 45, 50, 55, 60, 65, or about 70 mol % of the total lipid present in the LNP. In further embodiments, the LNPs comprise from about 25% to about 75% on a molar basis of ionizable cationic lipid, e.g., from about 20 to about 70%, from about 35 to about 65%, from about 45 to about 65%, about 60%, about 57.5%, about 57.1%, about 50% or about 40% on a molar basis (based upon 100% total moles of lipid in the lipid nanoparticle). In some embodiments, the ratio of ionizable cationic lipid to RNA is from about 3 to about 15, such as from about 5 to about 13 or from about 7 to about 11.

Other suitable (cationic or ionizable) lipids are disclosed in WO2009/086558, WO2009/127060, WO2010/048536, WO2010/054406, WO2010/088537, WO2010/129709, WO2011/153493, WO 2013/063468, US2011/0256175, US2012/0128760, US2012/0027803, U.S. Pat. No. 8,158,601, WO2016/118724, WO2016/118725, WO2017/070613, WO2017/070620, WO2017/099823, WO2012/040184, WO2011/153120, WO2011/149733, WO2011/090965, WO2011/043913, WO2011/022460, WO2012/061259, WO2012/054365, WO2012/044638, WO2010/080724, WO2010/21865, WO2008/103276, WO2013/086373, WO2013/086354, U.S. Pat. Nos. 7,893,302, 7,404,969, 8,283,333, 8,466,122 and 8,569,256 and US Patent Publication No. US2010/0036115, US2012/0202871, US2013/0064894, US2013/0129785, US2013/0150625, US2013/0178541, US2013/0225836, US2014/0039032 and WO2017/112865. In that context, the disclosures of WO2009/086558, WO2009/127060, WO2010/048536, WO2010/054406, WO2010/088537, WO2010/129709, WO2011/153493, WO 2013/063468, US2011/0256175, US2012/0128760, US2012/0027803, U.S. Pat. No. 8,158,601, WO2016/118724, WO2016/118725, WO2017/070613, WO2017/070620, WO2017/099823, WO2012/040184, WO2011/153120, WO2011/149733, WO2011/090965, WO2011/043913, WO2011/022460, WO2012/061259, WO2012/054365, WO2012/044638, WO2010/080724, WO2010/21865, WO2008/103276, WO2013/086373, WO2013/086354, U.S. Pat. Nos. 7,893,302, 7,404,969, 8,283,333, 8,466,122 and 8,569,256 and US Patent Publication No. US2010/0036115, US2012/0202871, US2013/0064894, US2013/0129785, US2013/0150625, US2013/0178541, US2013/0225836 and US2014/0039032 and WO2017/112865 specifically relating to (ionizable cationic) lipids suitable for LNPs are incorporated herewith by reference.

In embodiments, amino or ionizable cationic lipids as defined herein have at least one protonatable or deprotonatable group, such that the lipid is positively charged at a pH at or below physiological pH (e.g. pH 7.4), and neutral at a second pH, such as at or above physiological pH. It will, of course, be understood that the addition or removal of protons as a function of pH is an equilibrium process, and that the reference to a charged or a neutral lipid refers to the nature of the predominant species and does not require that all of lipids have to be present in the charged or neutral form. Lipids having more than one protonatable or deprotonatable group, or which are zwitterionic, are not excluded and may likewise be suitable in the context of the present invention. In some embodiments, the protonatable lipids have a pKa of the protonatable group in the range of about 4 to about 11, e.g., a pKa of about 5 to about 7.

LNPs can comprise two or more (different) ionizable cationic lipids as defined herein. Ionizable cationic lipids may be selected to contribute to different advantageous properties. For example, ionizable cationic lipids that differ in properties such as amine pKa, chemical stability, half-life in circulation, half-life in tissue, net accumulation in tissue, or toxicity can be used in the LNP. In embodiments, the ionizable cationic lipids can be chosen so that the properties of the mixed-LNP are more desirable than the properties of a single-LNP of individual lipids.

The amount of the ionizable lipid or lipidoid may be selected taking the amount of the nucleic acid cargo into account. In one embodiment, these amounts are selected such as to result in an N/P ratio of the nanoparticle(s) or of the composition in the range from about 0.1 to about 20. In this context, the N/P ratio is defined as the mole ratio of the nitrogen atoms ("N") of the basic nitrogen-containing groups of the lipid or lipidoid to the phosphate groups ("P") of the nucleic acid which is used as cargo. The N/P ratio may be calculated on the basis that, for example, 1 ug RNA typically contains about 3 nmol phosphate residues, provided that the RNA exhibits a statistical distribution of bases. The "N"-value of the lipid or lipidoid may be calculated on the basis of its molecular weight and the relative content of ionizable or cationisable groups.

In some embodiments, the N/P ratio of the lipid-based carriers to the RNA is in a range from about 1 to about 10, or in a range from about 1 to about 7, or in a range from about 5 to about 7, e.g. about 5.5, about 5.6, about 5.7, about 5.8, about 5.9, about 6, about 6.1, about 6.2, bout 6.3, about 6.4, about 6.5. In embodiments, the N/P ratio of the lipid-based carriers to the RNA is about 6.

In vivo characteristics and behavior of LNPs can be modified by addition of a hydrophilic polymer coating, e.g. polyethylene glycol (PEG), to the LNP surface to confer steric stabilization. Furthermore, LNPs can be used for specific targeting by attaching ligands (e.g. antibodies, peptides, and carbohydrates) to its surface or to the terminal end of the attached PEG chains (e.g. via PEGylated lipids or PEGylated cholesterol).

In some embodiments, the LNPs comprise a polymer conjugated lipid. The term "polymer conjugated lipid" refers to a molecule comprising both a lipid portion and a polymer portion. An example of a polymer conjugated lipid is a PEGylated lipid. The term "PEGylated lipid" refers to a molecule comprising both a lipid portion and a polyethylene glycol portion. PEGylated lipids are known in the art and include 1-(monomethoxy-polyethyleneglycol)-2,3-dimyristoylglycerol (PEG-s-DMG) and the like.

A polymer conjugated lipid as defined herein, e.g. a PEG-lipid, may serve as an aggregation reducing lipid. Vice versa, in preferred embodiments, the aggregation reducing lipid is a polymer conjugated lipid.

In some embodiments, the lipid-based carriers (e.g. preferably LNPs) comprise an aggregation reducing lipid in a molar ratio of about 0.5% to about 15%, or in a molar ratio of about 1.0% to about 2.5%, for example in a molar ratio of about 1.4%, about 1.5%, about 1.6%, about 1.7%, about 1.8%, about 1.9%. In embodiments, the lipid-based carriers comprise the aggregation reducing lipid in a molar ratio of about 1.7% (based on 100% total moles of lipids in the lipid-based carriers).

In some embodiments, the lipid-based carriers (e.g. preferably LNPs) comprise an aggregation reducing lipid in a weight ratio of about 2% to about 10%, or in a weight ratio of about 4% to about 10%, for example in a weight ratio of about 5%, about 6%, about 7%, about 8%, about 9%. In some embodiments, the lipid-based carriers comprise the aggregation reducing lipid in a weight ratio of about 6.97% (based on 100% total weight of lipids in the lipid-based carriers).

The term "aggregation reducing lipid" refers to a molecule comprising both a lipid portion and a moiety suitable of reducing or preventing aggregation of the lipid-based carriers in the vaccine. Under storage conditions, the lipid-based carriers may undergo charge-induced aggregation, a condition which can be undesirable for the stability of the vaccine. Therefore, it can be desirable to include a lipid compound which can reduce aggregation, for example by sterically stabilizing the lipid-based carriers. Such a steric stabilization may occur when a compound having a sterically bulky but uncharged moiety that shields or screens the charged portions of a lipid-based carriers from close approach to other lipid-based carriers in the vaccine. In the context of the invention, stabilization of the lipid-based carriers is achieved by including lipids which may comprise a lipid bearing a sterically bulky group which, after formation of the lipid-based carrier, is preferably located on the exterior of the lipid-based carrier. Suitable aggregation reducing groups include hydrophilic groups, e.g. polymers, such as poly(oxyalkylenes), e.g., a poly(ethylene glycol) or poly(propylene glycol). Lipids comprising a polymer as aggregation reducing group are herein referred to as "polymer conjugated lipid". In embodiments, the polymer conjugated lipid is a PEG-conjugated lipid (or PEGylated lipid or PEG lipid). In other embodiments, the polymer conjugated lipid is a PEG-free aggregation reducing lipid, such as a non-PEG polymer conjugated lipid.

Thus, in certain embodiments, the LNP comprises a stabilizing-lipid which is a polyethylene glycol-lipid (PEGylated lipid). Suitable polyethylene glycol-lipids include PEG-modified phosphatidylethanolamine, PEG-modified phosphatidic acid, PEG-modified ceramides (e.g. PEG-CerC14 or PEG-CerC20), PEG-modified dialkylamines, PEG-modified diacylglycerols, PEG-modified dialkylglycerols. Representative polyethylene glycol-lipids include PEG-c-DOMG, PEG-c-DMA, and PEG-s-DMG. In one embodiment, the polyethylene glycol-lipid is N-[(methoxy poly(ethylene glycol)2000)carbamyl]-1,2-dimyristyloxlpropyl-3-amine (PEG-c-DMA). In a preferred embodiment, the polyethylene glycol-lipid is PEG-2000-DMG. In one embodiment, the polyethylene glycol-lipid is PEG-c-DOMG). In other embodiments, the LNPs comprise a PEGylated diacylglycerol (PEG-DAG) such as 1-(monomethoxy-polyethyleneglycol)-2,3-dimyristoylglycerol (PEG-DMG), a PEGylated phosphatidylethanoloamine (PEG-PE), a PEG succinate diacylglycerol (PEG-S-DAG) such as 4-O-(2',3'-di(tetradecanoyloxy)propyl-1-O-(ω-methoxy(polyethoxy)ethyl)butanedioate (PEG-S-DMG), a PEGylated ceramide (PEG-cer), or a PEG dialkoxypropylcarbamate such as w-methoxy(polyethoxy)ethyl-N-(2,3di(tetradecanoxy)propyl)carbamate or 2,3-di(tetradecanoxy) propyl-N-(ω-methoxy(polyethoxy)ethyl)carbamate. In certain preferred embodiments the LNP comprises 1,2-dimyristoyl-rac-glycero-3-methoxypolyethylene glycol-2000 (PEG2000 DMG). Accordingly, in a specific embodiment, the lipid-based carrier encapsulating the RNA comprise a polymer conjugated lipid, preferably a PEG-conjugated lipid, wherein said PEG-conjugated lipid is 1,2-dimyristoyl-rac-glycero-3-methoxypolyethylene glycol 2000 (DMG-PEG 2000) according to or derived from the following structure:

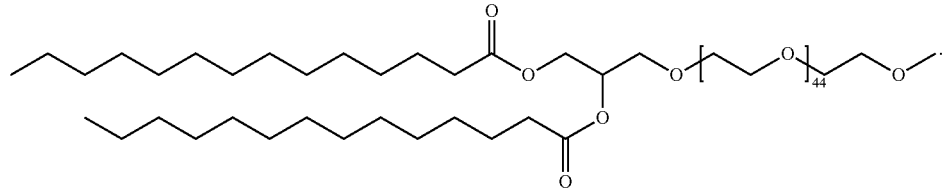

As used in the art, "DMG-PEG 2000" is considered a mixture of 1,2-DMG PEG2000 and 1,3-DMG PEG2000 in ~97:3 ratio.

In embodiments, the PEGylated lipid is derived from formula (IV) of published PCT patent application WO2018/078053A1. Accordingly, PEGylated lipids derived from formula (IV) of published PCT patent application WO2018/078053A1, and the respective disclosure relating thereto, are herewith incorporated by reference.

In embodiments, the at least one RNA of the composition is complexed with one or more lipids thereby forming LNPs, wherein the LNP comprises a PEGylated lipid, wherein the PEG lipid is derived from formula (IVa) of published PCT patent application WO2018/078053A1. Accordingly, PEGylated lipid derived from formula (IVa) of published PCT patent application WO2018/078053A1, and the respective disclosure relating thereto, is herewith incorporated by reference.

In a particularly preferred embodiment, the at least one RNA is complexed with one or more lipids thereby forming lipid nanoparticles (LNP), wherein the LNP comprises a PEGylated lipid/PEG lipid. Preferably, said PEG lipid is of formula (IVa):

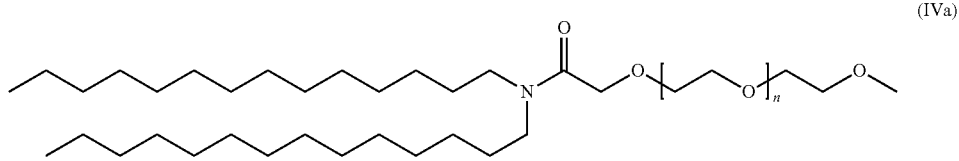

(IVa)

wherein n has a mean value ranging from 30 to 60, such as about 30±2, 32±2, 34±2, 36±2, 38±2, 40±2, 42±2, 44±2, 46±2, 48±2, 50±2, 52±2, 54±2, 56±2, 58±2, or 60±2. In embodiments n is about 49. In embodiments n is about 45.

In further aspects said PEG lipid is of formula (IVa) wherein n is an integer selected such that the average molecular weight of the PEG lipid is about 2000 g/mol to about 3000 g/mol or about 2300 g/mol to about 2700 g/mol, or about 2500 g/mol.

The lipid of formula IVa as suitably used herein has the chemical term 2[(polyethylene glycol)-2000]-N,N-ditetradecylacetamide, also referred to as ALC-0159.

Further examples of PEG-lipids suitable in that context are provided in US2015/0376115A1 and WO2015/199952, each of which is incorporated by reference in its entirety.

In some embodiments, LNPs include less than about 3, 2, or 1 mole percent of PEG or PEG-modified lipid, based on the total moles of lipid in the LNP. In further embodiments, LNPs comprise from about 0.1% to about 20% of the PEG-modified lipid on a molar basis, e.g., about 0.5 to about 10%, about 0.5 to about 5%, about 10%, about 5%, about 3.5%, about 3%, about 2.5%, about 2%, about 1.5%, about 1%, about 0.5%, or about 0.3% on a molar basis (based on 100% total moles of lipids in the LNP). In embodiments, LNPs comprise from about 1.0% to about 2.0% of the PEG-modified lipid on a molar basis, e.g., about 1.2 to about 1.9%, about 1.2 to about 1.8%, about 1.3 to about 1.8%, about 1.4 to about 1.8%, about 1.5 to about 1.8%, about 1.6 to about 1.8%, in particular about 1.4%, about 1.5%, about 1.6%, about 1.7%, about 1.8%, about 1.9%, or 1.7% (based on 100% total moles of lipids in the LNP). In various embodiments, the molar ratio of the ionizable cationic lipid to the PEGylated lipid ranges from about 100:1 to about 25:1.

In embodiments, the LNP comprises one or more additional lipids, which stabilize the formation of particles during their formation or during the manufacturing process (e.g. neutral lipid and/or one or more steroid or steroid analogue).

In embodiments of the second aspect, the at least one RNA is complexed with one or more lipids thereby forming lipid nanoparticles (LNP), wherein the LNP comprises one or more neutral lipid and/or one or more steroid or steroid analogue.

Suitable stabilizing lipids include neutral lipids and anionic lipids. The term "neutral lipid" refers to any one of a number of lipid species that exist in either an uncharged or neutral zwitterionic form at physiological pH. Representative neutral lipids include diacylphosphatidylcholines, diacylphosphatidylethanolamines, ceramides, sphingomyelins, dihydro sphingomyelins, cephalins, and cerebrosides.

In embodiments of the second aspect, the LNP comprises one or more neutral lipids, wherein the neutral lipid is selected from the group comprising distearoylphosphatidylcholine (DSPC), dioleoylphosphatidylcholine (DOPC), dipalmitoylphosphatidylcholine (DPPC), dioleoylphosphatidylglycerol (DOPG), dipalmitoylphosphatidylglycerol (DPPG), dioleoyl-phosphatidylethanolamine (DOPE), palmitoyloleoylphosphatidylcholine (POPC), palmitoyloleoyl-phosphatidylethanolamine (POPE) and dioleoyl-phosphatidylethanolamine 4-(N-maleimidomethyl)-cyclohexane-1carboxylate (DOPE-mal), dipalmitoyl phosphatidyl ethanolamine (DPPE), dimyristoylphosphoethanolamine (DMPE), distearoyl-phosphatidylethanolamine (DSPE), 16-O-monomethyl PE, 16-O-dimethyl PE, 18-1-trans PE, 1-stearioyl-2-oleoylphosphatidyethanol amine (SOPE), and 1,2-dielaidoyl-sn-glycero-3-phophoethanolamine (transDOPE), or mixtures thereof.

In some embodiments, the LNPs comprise a neutral lipid selected from DSPC, DPPC, DMPC, DOPC, POPC, DOPE and SM.

In various embodiments, the molar ratio of the ionizable cationic lipid to the neutral lipid ranges from about 2:1 to about 8:1.

In preferred embodiments, the neutral lipid is 1,2-distearoyl-sn-glycero-3-phosphocholine (DSPC). The molar ratio of the ionizable cationic lipid to DSPC may be in the range from about 2:1 to about 8:1.

In preferred embodiments, the steroid is cholesterol. The molar ratio of the ionizable cationic lipid to cholesterol may be in the range from about 2:1 to about 1:1. In some embodiments, the cholesterol may be PEGylated.

Suitably, the molar ratio of the ionizable cationic lipid to steroid or steroid analogue may be in the range from about 2:1 to about 1:1.

In some embodiments, the lipid-based carrier comprises about 10 mol % to about 60 mol % or about 25 mol % to about 40 mol % sterol (based on 100% total moles of lipids in the lipid-based carrier). In one embodiment, the sterol is about 10, 15, 20, 25, 30, 35, 40, 45, 50, 55, or about 60 mol % of the total lipid present in the lipid-based carrier. In another embodiment, the lipid-based carriers include from about 5% to about 50% on a molar basis of the sterol, e.g., about 15% to about 45%, about 20% to about 40%, about 48%, about 40%, about 38.5%, about 35%, about 34.4%, about 31.5% or about 30% on a molar basis (based upon 100% total moles of lipid in the lipid-based carrier). In preferred embodiments, the lipid-based carrier comprises about 28%, about 29% or about 30% sterol (based on 100% total moles of lipids in the lipid-based carrier). In most preferred embodiments, the lipid-based carrier comprises about 40.9% sterol (based on 100% total moles of lipids in the lipid-based carrier). In other embodiments, the lipid-based carriers (e.g., LNPs) of the invention as disclosed herein comprises a steroid or steroid analog in a molar ratio of about 25% to about 55%, preferably in a molar ratio of about 33% to about 49%, for example in a molar ratio of about 38%, 39%, 40%, 41%, 42%, 43%, or about 44%. In preferred embodiments, the lipid-based carriers comprise a steroid or steroid analog in a molar ratio of about 40.9% (based on 100% total moles of lipids in the carriers).

In embodiments, lipid nanoparticles (LNPs) comprise: (a) the at least one RNA of the first aspect, (b) an ionizable cationic lipid, (c) an aggregation reducing agent (such as polyethylene glycol (PEG) lipid or PEG-modified lipid), (d) optionally a non-cationic lipid (such as a neutral lipid), and (e) optionally, a sterol.

In some embodiments, the ionizable cationic lipids (as defined above), non-cationic lipids (as defined above), cholesterol (as defined above), and/or PEG-modified lipids (as defined above) may be combined at various relative molar ratios. For example, the ratio of ionizable cationic lipid to non-cationic lipid to cholesterol-based lipid to PEGylated lipid may be between about 30-60:20-35:20-30:1-15, or at a ratio of about 40:30:25:5, 50:25:20:5, 50:27:20:3, 40:30:20:10, 40:32:20:8, 40:32:25:3 or 40:33:25:2, or at a ratio of about 50:25:20:5, 50:20:25:5, 50:27:20:3 40:30:20:10, 40:30:25:5 or 40:32:20:8, 40:32:25:3 or 40:33:25:2, respectively.

In some embodiments, the LNPs comprise a lipid of formula (III), the at least one RNA as defined herein, a neutral lipid, a steroid and a PEGylated lipid. In preferred embodiments, the lipid of formula (III) is lipid compound III-3 (ALC-0315), the neutral lipid is DSPC, the steroid is cholesterol, and the PEGylated lipid is the compound of formula (IVa) (ALC-0159).

In a preferred embodiment of the second aspect, the LNP consists essentially of (i) at least one ionizable cationic lipid; (ii) a neutral lipid; (iii) a sterol, e.g. cholesterol; and (iv) a PEG-lipid, e.g. PEG-DMG or PEG-cDMA, in a molar ratio of about 20-60% ionizable cationic lipid: 5-25% neutral lipid: 25-55% sterol; 0.5-15% PEG-lipid.

In preferred embodiments, the at least RNA is complexed with one or more lipids thereby forming lipid nanoparticles (LNP), wherein the LNP comprises:
(i) at least one ionizable cationic lipid as defined herein, preferably a lipid of formula (X-1), SM-102;
(ii) at least one neutral lipid as defined herein, preferably 1,2-distearoyl-sn-glycero-3-phosphocholine (DSPC);
(iii) at least one steroid or steroid analogue as defined herein, preferably cholesterol; and
(iv) at least one PEG-lipid as defined herein, e.g. PEG-DMG or PEG-cDMA, preferably 1,2-dimyristoyl-rac-glycero-3-methoxypolyethylene glycol-2000 (PEG2000 DMG).

In preferred embodiments, the at least one RNA is complexed with one or more lipids thereby forming lipid nanoparticles (LNP), wherein the LNP comprises (i) to (iv) in a molar ratio of about 20-60% ionizable cationic lipid: 5-25% neutral lipid: 25-55% sterol; 0.5-15% PEG-lipid.

In one preferred embodiment, the lipid nanoparticle comprises: an ionizable cationic lipid with formula (X-1) and/or PEG lipid comprising PEG2000 DMG, optionally a neutral lipid, preferably 1,2-distearoyl-sn-glycero-3-phosphocholine (DSPC) and optionally a steroid, preferably cholesterol, wherein the molar ratio of the ionizable cationic lipid to DSPC is optionally in the range from about 2:1 to 8:1, wherein the molar ratio of the ionizable cationic lipid to cholesterol is optionally in the range from about 2:1 to 1:1.

In a preferred embodiment, the composition of the second aspect comprising the at least one RNA, comprises lipid nanoparticles (LNPs), which have a molar ratio of 45-55:5-15:35-45:1-3, 47-50:9-14:36-42:1-2 or more preferably about 48.5:11.1:38.9:1.5 (i.e. proportion (mol %) of ionizable cationic lipid (preferably lipid X-1 (SM-102)), DSPC, cholesterol and PEG-lipid (preferably PEG2000 DMG).

In preferred embodiments, the at least RNA is complexed with one or more lipids thereby forming lipid nanoparticles (LNP), wherein the LNP comprises:

(i) at least one ionizable cationic lipid as defined herein, preferably a lipid of formula (III), more preferably lipid III-3 (ALC-0315);
(ii) at least one neutral lipid as defined herein, preferably 1,2-distearoyl-sn-glycero-3-phosphocholine (DSPC);
(iii) at least one steroid or steroid analogue as defined herein, preferably cholesterol; and
(iv) at least one PEG-lipid as defined herein, e.g. PEG-DMG or PEG-cDMA, preferably a PEGylated lipid that is or is derived from formula (IVa) (ALC-0159).

In preferred embodiments, the at least one RNA is complexed with one or more lipids thereby forming lipid nanoparticles (LNP), wherein the LNP comprises (i) to (iv) in a molar ratio of about 20-60% ionizable cationic lipid: 5-25% neutral lipid: 25-55% sterol; 0.5-15% PEG-lipid.

In one preferred embodiment, the lipid nanoparticle comprises: an ionizable cationic lipid with formula (III) and/or PEG lipid with formula (IV), optionally a neutral lipid, preferably 1,2-distearoyl-sn-glycero-3-phosphocholine (DSPC) and optionally a steroid, preferably cholesterol, wherein the molar ratio of the ionizable cationic lipid to DSPC is optionally in the range from about 2:1 to 8:1, wherein the molar ratio of the ionizable cationic lipid to cholesterol is optionally in the range from about 2:1 to 1:1.

In a preferred embodiment, the composition of the second aspect comprising the at least one RNA, comprises lipid nanoparticles (LNPs), which have a molar ratio of approximately 50:10:38.5:1.5, preferably 47.5:10:40.8:1.7 or more preferably 47.4:10:40.9:1.7 or 47.5:10:40.7:1.8 (i.e. proportion (mol %) of ionizable cationic lipid (preferably lipid III-3 (ALC-0315)), DSPC, cholesterol and PEG-lipid (preferably PEG-lipid of formula (IVa) with n=49, even more preferably PEG-lipid of formula (IVa) with n=45 (ALC-0159)); solubilized in ethanol).

In embodiments, the composition of the second aspect comprises at least one RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NOs: 102-112, 127-137 formulated in lipid nanoparticles (LNPs), which have a molar ratio of approximately 50:10:38.5:1.5, preferably 47.5:10:40.8:1.7 or more preferably 47.4:10:40.9:1.7 or 47.5:10:40.7:1.8 proportion (mol %) of ionizable cationic lipid III-3 (ALC-0315), DSPC, cholesterol and PEG-lipid of formula (IVa) (with n=49 or with n=45 (ALC-0159)).

In embodiments where the composition is a multivalent composition as defined above, the RNA species, such as mRNA species of the multivalent composition may be formulated separately, e.g. may be formulated separately in liposomes or LNPs. Suitably, the RNA species of the multivalent composition are separately formulated in LNPs which have a molar ratio of approximately 50:10:38.5:1.5, preferably 47.5:10:40.8:1.7 or 47.4:10:40.9:1.7 or 47.5:10:40.7:1.8 proportion (mol %) of ionizable cationic lipid III-3 (ALC-0315), DSPC, cholesterol and PEG-lipid of formula (IVa) (with n=49 or with n=45). Nucleic acid species for multivalent compositions are selected as defined above (see section "Multivalent compositions of the invention").

In that context, the composition may comprise:
at least one RNA, which is identical or at least 90%, 91%, 92%, 93%, 94%, 95%, 96%, 97%, 98%, or 99% identical to a nucleic acid sequence of SEQ ID NO: 127-137 formulated in lipid nanoparticles (LNPs), which have a molar ratio of approximately 50:10:38.5:1.5, preferably 47.5:10:40.8:1.7 or more preferably 47.4:10:40.9:1.7 or 47.5:10:40.7:1.8 proportion (mol %) of ionizable cationic lipid III-3 (ALC-0315), DSPC, cholesterol and PEG-lipid of formula (IVa) (with n=49 or with n=45 (ALC-0159)); and/or at least one RNA, which is identical or at least 90%, 91%, 92%, 93%, 94%, 95%, 96%, 97%, 98%, or 99% identical to nucleic acid sequence of SEQ ID NO: 156 formulated in lipid nanoparticles (LNPs), which have a molar ratio of approximately 50:10:38.5:1.5, preferably 47.5:10:40.8:1.7 or more preferably 47.4:10:40.9:1.7 or 47.5:10:40.7:1.8 proportion (mol %) of ionizable cationic lipid III-3 (ALC-0315), DSPC, cholesterol and PEG-lipid of formula (IVa) (with n=49 or with n=45 (ALC-0159)); and/or at least one RNA, which is identical or at least 90%, 91%, 92%, 93%, 94%, 95%, 96%, 97%, 98%, or 99% identical to nucleic acid sequence of SEQ ID NO: 157 formulated in lipid nanoparticles (LNPs), which have a molar ratio of approximately 50:10:38.5:1.5, preferably 47.5:10:40.8:1.7 or more preferably 47.4:10:40.9:1.7 or 47.5:10:40.7:1.8 proportion (mol %) of ionizable cationic lipid III-3 (ALC-0315), DSPC, cholesterol and PEG-lipid of formula (IVa) (with n=49 or with n=45 (ALC-0159)); and/or at least one RNA, which is identical or at least 90%, 91%, 92%, 93%, 94%, 95%, 96%, 97%, 98%, or 99% identical to nucleic acid sequence of SEQ ID NO: 158 formulated in lipid nanoparticles (LNPs), which have a molar ratio of approximately 50:10:38.5:1.5, preferably 47.5:10:40.8:1.7 or more preferably 47.4:10:40.9:1.7 or 47.5:10:40.7:1.8 proportion (mol %) of ionizable cationic lipid III-3 (ALC-0315), DSPC, cholesterol and PEG-lipid of formula (IVa) (with n=49 or with n=45 (ALC-0159)); and/or at least one RNA, which is identical or at least 90%, 91%, 92%, 93%, 94%, 95%, 96%, 97%, 98%, or 99% identical to nucleic acid sequence of SEQ ID NO: 150 formulated in lipid nanoparticles (LNPs), which have a molar ratio of approximately 50:10:38.5:1.5, preferably 47.5:10:40.8:1.7 or more preferably 47.4:10:40.9:1.7 or 47.5:10:40.7:1.8 proportion (mol %) of ionizable cationic lipid III-3 (ALC-0315), DSPC, cholesterol and PEG-lipid of formula (IVa) (with n=49 or with n=45 (ALC-0159)).

In embodiments where the composition is a multivalent composition as defined above, the nucleic acid species (e.g. DNA or RNA), such as RNA species of the multivalent composition may be co-formulated, or co-formulated in liposomes or LNPs. Suitably, the RNA species of the multivalent composition are co-formulated in LNPs which have a molar ratio of approximately 50:10:38.5:1.5, or 47.5:10:40.8:1.7 or 47.4:10:40.9:1.7 or 47.5:10:40.7:1.8 proportion (mol %) of ionizable cationic lipid III-3 (ALC-0315), DSPC, cholesterol and PEG-lipid of formula (IVa) (with n=49 or with n=45). Nucleic acid species for multivalent compositions are selected as defined above (see section "Multivalent compositions of the invention").

The total amount of RNA in the lipid nanoparticles may vary and is defined depending on the e.g. nucleic acid to total lipid w/w ratio. In one embodiment of the invention the nucleic acid, in particular the RNA to total lipid ratio is less than 0.06 w/w, or between 0.03 w/w and 0.04 w/w.

In various embodiments, the vaccine of the invention as disclosed herein comprises a certain concentration of lipid (or the lipid-based carriers encapsulating the RNA).

In some embodiments, the weight to weight (wt/wt) ratio of lipid to the RNA (in the lipid-based carriers) in the vaccine of the invention as disclosed herein is from about 10:1 to about 60:1. In embodiments, the weight to weight (wt/wt) ratio of lipid to the RNA (in the lipid-based carriers) is from about 20:1 to about 30:1. In some embodiments, the weight to weight (wt/wt) ratio of lipid to the RNA (in the lipid-based carriers) is for example about 20:1, about 21:1, about 22:1, about 23:1, about 24:1, about 25:1, about 26:1, about 27:1, about 28:1, about 29:1, or about 30:1. In embodiments, the wt/wt ratio of lipid to the RNA (in the lipid-based carriers) is about 25:1.

In some embodiments, the RNA to total lipid ratio in the lipid-based carriers is less than about 0.1 w/w, less than about 0.06 w/w. In embodiments, the RNA to total lipid ratio in the lipid-based carriers is between about 0.03 w/w and 0.05 w/w. In embodiments, the RNA to total lipid ratio in the lipid-based carriers is between about 0.04 w/w.

In some embodiments, the lipid nanoparticles (LNPs), which are composed of only three lipid components, namely imidazole cholesterol ester (ICE), 1,2-dioleoyl-sn-glycero-3-phosphoethanolamine (DOPE), and 1,2-dimyristoyl-sn-glycerol, methoxypolyethylene glycol (DMG-PEG-2K).

In one embodiment, the lipid nanoparticle of the composition comprises an ionizable cationic lipid, a steroid; a neutral lipid; and a polymer conjugated lipid, preferably a pegylated lipid. Preferably, the polymer conjugated lipid is a pegylated lipid or PEG-lipid. In a specific embodiment, lipid nanoparticles comprise an ionizable cationic lipid resembled by the ionizable cationic lipid COATSOME® SS-EC (former name: SS-33/4PE-15; NOF Corporation, Tokyo, Japan), in accordance with the following formula:

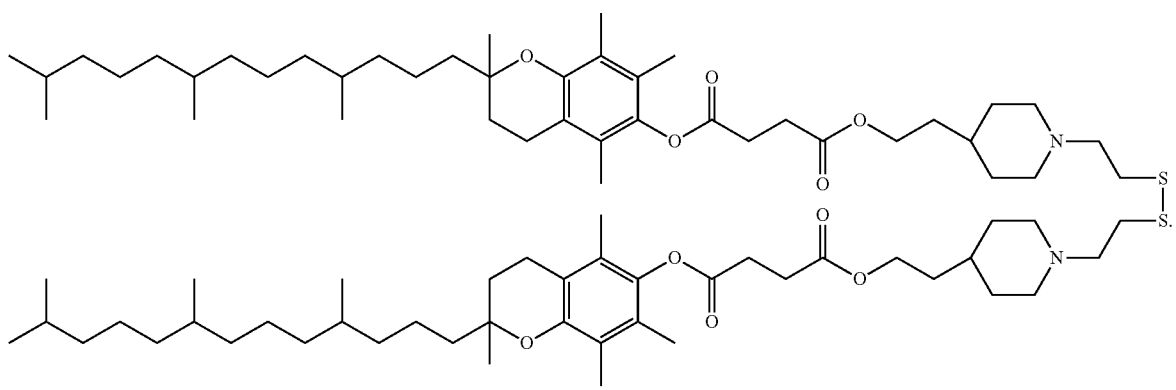 [SMILES: Cc1c(C)c2c(c(C)c1OC(=O)CCC(=O)OCCC1CCN(CCSSCCN3CCC(CCOC(=O)CCC(=O)Oc4c(C)c(C)c5c(c4C)CCC(C)(CCCC(C)CCCC(C)CCCC(C)C)O5)CC3)CC1)CCC(C)(CCCC(C)CCCC(C)CCCC(C)C)O2]

As described further below, those lipid nanoparticles are termed "GN01".

Furthermore, in a specific embodiment, the GN01 lipid nanoparticles comprise a neutral lipid being resembled by the structure 1,2-diphytanoyl-sn-glycero-3-phosphoethanolamine (DPhyPE):

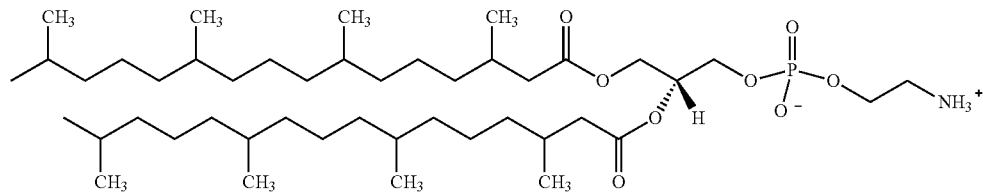 [SMILES: CC(C)CCCC(C)CCCC(C)CCCC(C)CC(=O)OC[C@H](COP(=O)([O-])OCC[NH3+])OC(=O)CC(C)CCCC(C)CCCC(C)CCCC(C)C]

Furthermore, in a specific embodiment, the GN01 lipid nanoparticles comprise a polymer conjugated lipid, preferably a pegylated lipid, being 1,2-dimyristoyl-rac-glycero-3-methoxypolyethylene glycol 2000 (DMG-PEG 2000).

Accordingly, GN01 lipid nanoparticles (GN01-LNPs) comprise a SS-EC ionizable cationic lipid, neutral lipid DPhyPE, cholesterol, and the polymer conjugated lipid (pegylated lipid) 1,2-dimyristoyl-rac-glycero-3-methoxypolyethylene glycol (PEG-DMG).

In a preferred embodiment, the GN01 LNPs comprise:
(a) ionizable cationic lipid SS-EC (former name: SS-33/4PE-15; NOF Corporation, Tokyo, Japan) at an amount of 45-65 mol %;
(b) cholesterol at an amount of 25-45 mol %;
(c) DPhyPE at an amount of 8-12 mol %; and
(d) PEG-DMG 2000 at an amount of 1-3 mol %;
each amount being relative to the total molar amount of all lipidic excipients of the GN01 lipid nanoparticles.

In a further preferred embodiment, the GN01 lipid nanoparticles as described herein comprises 59 mol % ionizable cationic lipid, 10 mol % neutral lipid, 29.3 mol % steroid and 1.7 mol % polymer conjugated lipid, preferably pegylated lipid. In a most preferred embodiment, the GN01 lipid nanoparticles as described herein comprise 59 mol % cationic lipid SS-EC, 10 mol % DPhyPE, 29.3 mol % cholesterol and 1.7 mol % DMG-PEG 2000.

The amount of the ionizable cationic lipid relative to that of the nucleic acid in the GN01 lipid nanoparticle may also be expressed as a weight ratio (abbreviated f.e. "m/m"). For example, the GN01 lipid nanoparticles comprise the at least one nucleic acid, such as the at least one RNA at an amount such as to achieve a lipid to RNA weight ratio in the range of about 20 to about 60, or about 10 to about 50. In other embodiments, the ratio of ionizable cationic lipid to nucleic acid or RNA is from about 3 to about 15, such as from about 5 to about 13, from about 4 to about 8 or from about 7 to about 11. In a preferred embodiment of the present invention, the total lipid/RNA mass ratio is about 40 or 40, i.e. about 40 or 40 times mass excess to ensure RNA encapsulation. Another preferred RNA/lipid ratio is between about 1 and about 10, about 2 and about 5, about 2 and about 4, or preferably about 3.

Further, the amount of the ionizable cationic lipid may be selected taking the amount of the nucleic acid cargo such as the RNA compound into account. In one embodiment, the N/P ratio can be in the range of about 1 to about 50. In another embodiment, the range is about 1 to about 20, about 1 to about 10, about 1 to about 5. In one embodiment, these amounts are selected such as to result in an N/P ratio of the GN01 lipid nanoparticles or of the composition in the range from about 10 to about 20. In a further very preferred embodiment, the N/P is 14 (i.e. 14 times mol excess of positive charge to ensure nucleic acid encapsulation).

In embodiments, GN01 lipid nanoparticles comprise 59 mol % ionizable cationic lipid COATSOME® SS-EC (former name: SS-33/4PE-15 as apparent from the examples section; NOF Corporation, Tokyo, Japan), 29.3 mol % cholesterol as steroid, 10 mol % DPhyPE as neutral lipid/phospholipid and 1.7 mol % DMG-PEG 2000 as polymer conjugated lipid. A further inventive advantage connected with the use of DPhyPE is the high capacity for fusogenicity due to its bulky tails, whereby it is able to fuse at a high level with endosomal lipids. For "GN01", N/P (lipid to nucleic acid, e.g RNA mol ratio) preferably is 14 and total lipid/RNA mass ratio preferably is 40 (m/m).

In other embodiments, the at least one RNA, such as the at least one mRNA is complexed with one or more lipids thereby forming lipid nanoparticles (LNP), wherein the LNP comprises:
(i) at least one ionizable cationic lipid;
(ii) at least one neutral lipid;
(iii) at least one steroid or steroid analogue; and
(iv) at least one PEG-lipid as defined herein, wherein the ionizable cationic lipid is DLin-KC2-DMA (50 mol %) or DLin-MC3-DMA (50 mol %), the neutral lipid is DSPC (10 mol %), the PEG lipid is PEG-DOMG (1.5 mol %) and the structural lipid is cholesterol (38.5 mol %).

The term "structural lipid" refers to a steroid lipid, e.g., cholesterol, fecosterol, sitosterol, ergosterol, campesterol, stigmasterol, brassicasterol, tomatidine, tomatine, ursolic acid, or alpha-tocopherol). A "steroid" is an organic compound with four rings arranged in a specific molecular configuration. It comprises the following carbon skeleton:

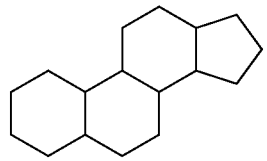 [SMILES: C1CCC2C(C1)CCC1C3CCCC3CCC21]

Steroids and neutral steroids include both naturally occurring steroids and analogues thereof (e.g. being amphipathic lipid cholesteryl hemisuccinate (CHEMS) which consists of succinic acid esterified to the beta-hydroxyl group of cholesterol as cholesterol derivate). Using the definition for "neutral" as provided herein, the neutral steroid may be a steroid either having no atoms or groups that are ionizable under physiological conditions, or it may be a zwitterionic steroid. In one of the preferred embodiments, the neutral steroid is free of atoms or groups that are ionizable under physiological conditions. In some preferred embodiments, the steroid or steroid analogue is cholesterol. The term "steroid" and "neutral steroid" is used herein interchangeably. In other embodiments, the sterol may be selected from the group consisting of a phytosterol, e.g. β-sitosterol, campesterol, stigmasterol, fucosterol, stigmastanol, dihydrocholesterol, ent-cholesterol, epi-cholesterol, desmosterol, cholestanol, cholestanone, cholestenone, cholesteryl-2'-hydroxyethyl ether, cholesteryl-4'-hydroxybutyl ether, 3β-[N—(N'N'-dimethylaminoethyl)carbamoyl cholesterol (DC-Chol), 24(S)-hydroxycholesterol, 25-hydroxy cholesterol, 25(R)-27-hydroxycholesterol, 22-oxacholesterol, 23-oxacholesterol, 24-oxacholesterol, cycloartenol, 22-ketosterol, 20-hydroxysterol, 7-hydroxycholesterol, 19-hydroxycholesterol, 22-hydroxycholesterol, 25-hydroxy cholesterol, 7-dehydrocholesterol, 5a-cholest-7-en-3β-ol, 3,6,9-trioxaoctan-1-ol-cholesteryl-3e-ol, dehydroergosterol, dehydroepiandrosterone, lanosterol, dihydrolanosterol, lanostenol, lumisterol, sitocalciferol, calcipotriol, coprostanol, cholecalciferol, lupeol, ergocalciferol, 22-dihydroegocalciferol, ergosterol, brassicasterol, tomatidine, tomatine, ursolic acid, cholic acid, chenodeoxycholic acid, zymosterol, diosgenin, fucosterol, fecosterol, or fecosterol, or a salt or ester thereof, cholesterol, cholesterol succinic acid, cholesterol sulfate, cholesterol hemisuccinate, cholesterol phthalate, cholesterol phosphate, cholesterol valerate, cholesterol acetate, cholesteryl oleate, cholesteryl linoleate, cholesteryl myristate, cholesteryl palmitate, cholesteryl arachidate, cholesteryl phosphorylcholine, and sodium cholate.

In other embodiments, the at least one RNA, such as the at least one mRNA is complexed with one or more lipids thereby forming lipid nanoparticles (LNP), wherein the LNP comprises SS15/Chol/DOPE (or DOPC)/DSG-5000 at mol % 50/38.5/10/1.5.

In other embodiments, the RNA of the invention may be formulated in liposomes, e.g. in liposomes as described in WO2019/222424, WO2019/226925, WO2019/232095, WO2019/232097, or WO2019/232208, the disclosure of WO2019/222424, WO2019/226925, WO2019/232095, WO2019/232097, or WO2019/232208 relating to liposomes or lipid-based carrier molecules herewith incorporated by reference.

In various embodiments, LNPs that suitably encapsulates the at least one RNA of the invention have a mean diameter of from about 50 nm to about 200 nm, from about 60 nm to about 200 nm, from about 70 nm to about 200 nm, from about 80 nm to about 200 nm, from about 90 nm to about 200 nm, from about 90 nm to about 190 nm, from about 90 nm to about 180 nm, from about 90 nm to about 170 nm, from about 90 nm to about 160 nm, from about 90 nm to about 150 nm, from about 90 nm to about 140 nm, from about 90 nm to about 130 nm, from about 90 nm to about 120 nm, from about 90 nm to about 100 nm, from about 70 nm to about 90 nm, from about 80 nm to about 90 nm, from about 70 nm to about 80 nm, or about 30 nm, 35 nm, 40 nm, 45 nm, 50 nm, 55 nm, 60 nm, 65 nm, 70 nm, 75 nm, 80 nm, 85 nm, 90 nm, 95 nm, 100 nm, 105 nm, 110 nm, 115 nm, 120 nm, 125 nm, 130 nm, 135 nm, 140 nm, 145 nm, 150 nm, 160 nm, 170 nm, 180 nm, 190 nm, or 200 nm and are substantially non-toxic. As used herein, the mean diameter may be represented by the z-average as determined by dynamic light scattering as commonly known in the art.

In various embodiments, the lipid-based carriers are monodispersed, meaning that the lipid-based carriers comprised in the vaccine of the invention as disclosed herein have a uniform size. Typically, the distribution of size populations within a composition is expressed by the polydispersity index (PDI) value. The term "polydispersity index" (PDI) is used herein as a measure of the size distribution of an ensemble of particles, e.g., lipid-based carriers. The polydispersity index is calculated based on dynamic light scattering measurements by the so-called cumulant analysis. Typically, the PDI is determined by dynamic light scattering at an angle of 173°, typically measured at a temperature of 25° C. PDI is basically a representation of the distribution of size populations within a given sample.

The numerical value of PDI ranges from 0.0 (for a perfectly uniform sample with respect to the particle size) to 1.0 (for a highly polydisperse sample with multiple particle size populations). The polydispersity index (PDI) of the lipid-based carriers of the invention, preferably lipid nanoparticles, is typically in the range of 0.1 to 0.5. In a particular preferred embodiment, a PDI is below 0.2. In some embodiments, the lipid-based carriers in the vaccine of the invention as disclosed herein have as a polydispersity index (PDI) value ranging from about 0.50 to about 0.00. In some embodiments, the lipid-based carriers encapsulating the RNA have a polydispersity index (PDI) value of less than about 0.3, preferably of less than about 0.2, more preferably of less than about 0.15, most preferably of less than about 0.1.

In embodiments, the lipid-based carriers of the vaccine of the invention or lipid nanoparticles as disclosed herein have a Z-average size ranging from about 50 nm to about 150 nm, preferably in a range from about 50 nm to about 120 nm, more preferably in a range from about 60 nm to about 115 nm. Suitably, the Z-average size may be determined by DLS as commonly known in the art. In some embodiments, the lipid-based carriers have a Z-average size of less than about 150 nm, less than about 120 nm, less than about 100 nm, or less than about 80 nm. Suitably, the Z-average size may be determined by DLS as commonly known in the art.

In another embodiment of the invention the lipid nanoparticles have a hydrodynamic diameter in the range from about 50 nm to about 300 nm, or from about 60 nm to about 250 nm, from about 60 nm to about 150 nm, or from about 60 nm to about 120 nm, respectively.

In embodiments where more than one or a plurality, e.g. 2, 3, 4, 5, 6, 7, 8, 9, 10, 11, 12, 13, 14, 15 of RNA species of the invention are comprised in the composition, said more than one or said plurality e.g. 2, 3, 4, 5, 6, 7, 8, 9, 10, 11, 12, 13, 14, 15 of RNA species of the invention may be complexed within one or more lipids thereby forming LNPs comprising more than one or a plurality, e.g. 2, 3, 4, 5, 6, 7, 8, 9, 10, 11, 12, 13, 14, 15 of different RNA species.

In embodiments, the LNPs preferably encapsulating or comprising RNA are purified by at least one purification step, preferably by at least one step of TFF and/or at least one step of clarification and/or at least one step of filtration. This purification particularly leads to reducing the amount of ethanol in the composition, which has been used for the lipid formulation.

In this context the composition comprises after purification less than about 500 ppM ethanol, less than about 50 ppM ethanol, or less than about 5 ppM ethanol.

In embodiments, the LNPs described herein may be lyophilized to improve storage stability of the formulation and/or the RNA. In embodiments, the LNPs described herein may be spray dried to improve storage stability of the formulation and/or the nucleic acid. Lyoprotectants for lyophilization and or spray drying may be selected from trehalose, sucrose, mannose, dextran and inulin. In embodiments, the lyoprotectant is sucrose, optionally comprising a further lyoprotectant. In embodiments the lyoprotectant is trehalose, optionally comprising a further lyoprotectant.

Accordingly, the composition, e.g. the composition comprising LNPs is lyophilized (e.g. according to WO2016/165831 or WO2011/069586, each of which is hereby incorporated in its entirety by reference) to yield a temperature stable dried nucleic acid (powder) composition as defined herein (e.g. RNA or DNA). The composition, e.g. the composition comprising LNPs may also be dried using spray-drying or spray-freeze drying (e.g. according to WO2016/184575 or WO2016/184576) to yield a temperature stable composition (powder) as defined herein.

Accordingly, in embodiments, the composition is a dried composition.

The term "dried composition" as used herein has to be understood as composition that has been lyophilized, or spray-dried, or spray-freeze dried as defined above to obtain a temperature stable dried composition (powder) e.g. comprising LNP complexed RNA (as defined above).

According to further embodiments, the composition of the second aspect may comprise at least one adjuvant.

Suitably, the adjuvant is added to enhance the immunostimulatory properties of the composition.

The term "adjuvant" as used herein refers to a pharmacological and/or immunological agent that may modify, e.g. enhance, the effect of other agents or that may be suitable to support administration and delivery of the composition.

The term "adjuvant" refers to a broad spectrum of substances. Typically, these substances are able to increase the immunogenicity of antigens. For example, adjuvants may be recognized by the innate immune systems and, e.g., may elicit an innate immune response (that is, a non-specific immune response). "Adjuvants" typically do not elicit an adaptive immune response. In the context of the invention, adjuvants may enhance the effect of the antigenic peptide or protein provided by the nucleic acid. In that context, the at least one adjuvant may be selected from any adjuvant known to a skilled person and suitable for the present case, i.e. supporting the induction of an immune response in a subject, e.g. in a human subject.

Accordingly, the composition of the second aspect may comprise at least one adjuvant, wherein the at least one adjuvant may be suitably selected from any adjuvant provided in WO2016/203025, which is hereby incorporated by reference. Adjuvants disclosed in any of the claims 2 to 17 of WO2016/203025, such as adjuvants disclosed in claim 17 of WO2016/203025 are particularly suitable, the specific content relating thereto herewith incorporated by reference.

The composition of the second aspect may comprise, besides the components specified herein, at least one further component which may be selected from the group consisting of further antigens (e.g. in the form of a peptide or protein, derived from a coronavirus) or further antigen-encoding nucleic acids (encoding peptide or protein, derived from a coronavirus); a further immunotherapeutic agent; one or more auxiliary substances (cytokines, such as monokines, lymphokines, interleukins or chemokines); or any further compound, which is known to be immune stimulating due to its binding affinity (as ligands) to human Toll-like receptors; and/or an adjuvant nucleic acid, such as an immunostimulatory RNA (isRNA), e.g. CpG-RNA etc.

As used herein, "stable" refers to a liquid composition comprising lipid-based carriers (e.g. LNPs) encapsulating an RNA where the measured values for various physiochemical parameters are within a defined range after storage. In one embodiment, the liquid composition comprising lipid-based carriers encapsulating an RNA is analyzed to assess stability according to various parameters. Suitable stability parameters include, without limitation, RNA integrity, Z-average particle size, polydispersity index (PDI), the amount of free RNA in the liquid composition, encapsulation efficiency of the RNA (proportion of the RNA in percent incorporated with lipid-based carriers), shape and morphology of the lipid-based carriers encapsulating an RNA, pH, osmolality, or turbidity. Further, "stable" refers to a liquid composition comprising lipid-based carriers encapsulating an RNA where the measured values for various functional parameters are within a defined range after storage. In one embodiment, the liquid composition comprising lipid-based carriers encapsulating an RNA is analyzed to assess the potency of the liquid composition including for example the expression of the encoded peptide or protein, the induction of specific antibody titers, the induction of neutralizing antibody titers, the induction of T-cell, the reactogenicity of the liquid composition including for example the induction of innate immune responses etc.

In embodiments, the term "stable" refers to RNA integrity.

The term "RNA integrity" generally describes whether the complete RNA sequence is present in the liquid composition. Low RNA integrity could be due to, amongst others, RNA degradation, RNA cleavage, incorrect or incomplete chemical synthesis of the RNA, incorrect base pairing, integration of modified nucleotides or the modification of already integrated nucleotides, lack of capping or incomplete capping, lack of polyadenylation or incomplete polyadenylation, or incomplete RNA in vitro transcription. RNA is a fragile molecule that can easily degrade, which may be caused e.g. by temperature, ribonucleases, pH or other factors (e.g. nucleophilic attacks, hydrolysis etc.), which may reduce the RNA integrity and, consequently, the functionality of the RNA.

In embodiments, the RNA of a composition has an RNA integrity of at least about 50%, of at least about 60%, of at least about 70%, of at least about 80% or about 90%. RNA is suitably determined using analytical HPLC, such as analytical RP-HPLC.

The skilled person can choose from a variety of different chromatographic or electrophoretic methods for determining an RNA integrity. Chromatographic and electrophoretic methods are well-known in the art. In case chromatography is used (e.g. RP-HPLC), the analysis of the integrity of the RNA may be based on determining the peak area (or "area under the peak") of the full length RNA in a corresponding chromatogram. The peak area may be determined by any suitable software which evaluates the signals of the detector system. The process of determining the peak area is also referred to as integration. The peak area representing the full-length RNA is typically set in relation to the peak area of the total RNA in a respective sample. The RNA integrity may be expressed in % RNA integrity.

In the context of aspects of the invention, RNA integrity may be determined using analytical (RP)HPLC. Typically, a test sample of the liquid composition comprising lipid-based carrier encapsulating RNA may be treated with a detergent (e.g. about 2% Triton X100) to dissociate the lipid-based carrier and to release the encapsulated RNA. The released RNA may be captured using suitable binding compounds, e.g. Agencourt AMPure XP beads (Beckman Coulter, Brea, CA, USA) essentially according to the manufacturer's instructions. Following preparation of the RNA sample, analytical (RP)HPLC may be performed to determine the integrity of RNA. Typically, for determining RNA integrity, the RNA samples may be diluted to a concentration of 0.1 g/l using e.g. water for injection (WFI). About 10 µl of the diluted RNA sample may be injected into an HPLC column (e.g. a monolithic poly(styrene-divinylbenzene) matrix). Analytical (RP)HPLC may be performed using standard conditions, for example: Gradient 1: Buffer A (0.1 M TEAA (pH 7.0)); Buffer B (0.1 M TEAA (pH 7.0) containing 25% acetonitrile). Starting at 30% buffer B the gradient extended to 32% buffer B in 2 min, followed by an extension to 55% buffer B over 15 minutes at a flow rate of 1 ml/min. HPLC chromatograms are typically recorded at a wavelength of 260 nm. The obtained chromatograms may be evaluated using a software and the relative peak area may be determined in percent (%) as commonly known in the art. The relative peak area indicates the amount of RNA that has 100% RNA integrity. Since the amount of the RNA injected into the HPLC is typically known, the analysis of the relative peak area provides information on the integrity of the RNA. Thus, if e.g. 100 ng RNA have been injected in total, and 100 ng are determined as the relative peak area, the RNA integrity would be 100%. If, for example, the relative peak area would correspond to 80 ng, the RNA integrity would be 80%. Accordingly, RNA integrity in the context of the invention is determined using analytical HPLC, preferably analytical RP-HPLC.

In embodiments, 80% of RNA comprised in the liquid composition is encapsulated, or 85% of the RNA comprised in the composition is encapsulated, 90% of the RNA comprised in the composition is encapsulated, or 95% or more of the RNA comprised in the composition is encapsulated. The percentage of encapsulation may be determined by a Ribogreen assay as known in the art.

In embodiments, the composition comprises at least one antagonist of at least one RNA sensing pattern recognition receptor. Such an antagonist may preferably be co-formulated in lipid-based carriers as defined herein.

Suitable antagonists of at least one RNA sensing pattern recognition receptor are disclosed in PCT patent application WO2021/028439 (PCT/EP2020/072516), the full disclosure herewith incorporated by reference. In particular, the disclosure relating to suitable antagonist of at least one RNA sensing pattern recognition receptors as defined in any one of the claims 1 to 94 of WO2021/028439 (PCT/EP2020/072516) are incorporated.

In embodiments, the composition comprises at least one antagonist of at least one RNA sensing pattern recognition receptor selected from a Toll-like receptor, such as TLR7 and/or TLR8.

In embodiments, the at least one antagonist of at least one RNA sensing pattern recognition receptor is selected from a nucleotide, a nucleotide analog, a nucleic acid, a peptide, a protein, a small molecule, a lipid, or a fragment, variant or derivative of any of these.

In embodiments, the at least one antagonist of at least one RNA sensing pattern recognition receptor is a single stranded oligonucleotide, such as a single stranded RNA Oligonucleotide.

In embodiments, the antagonist of at least one RNA sensing pattern recognition receptor is a single stranded oligonucleotide that comprises or consists of a nucleic acid sequence identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 85-212 of WO2021/028439 (PCT/EP2020/072516), or fragments of any of these sequences.

In embodiments, the antagonist of at least one RNA sensing pattern recognition receptor is a single stranded oligonucleotide that comprises or consists of a nucleic acid sequence identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 85-87, 149-212 of WO2021/028439 (PCT/EP2020/072516), or fragments of any of these sequences.

In embodiments, the antagonist of at least one RNA sensing pattern recognition receptor in the context of the invention is 5'-GAG CGmG CCA-3' (SEQ ID NO: 85 of WO2021/028439 (PCT/EP2020/072516)), or a fragment thereof.

In embodiments, the molar ratio of the at least one antagonist of at least one RNA sensing pattern recognition receptor as defined herein to the at least one nucleic acid, such as RNA encoding a SARS-CoV-2 antigenic peptide or protein as defined herein suitably ranges from about 1:1, to about 100:1, or ranges from about 20:1, to about 80:1.

In embodiments, the wherein the weight-to-weight ratio of the at least one antagonist of at least one RNA sensing pattern recognition receptor as defined herein to the at least one nucleic acid, such as RNA encoding a SARS-CoV-2 antigenic peptide or protein as defined herein suitably ranges from about 1:1, to about 1:30, or ranges from about 1:2, to about 1:10.

In some embodiments, the lipid-based carriers of the invention as disclosed herein are purified lipid-based carriers. Suitably, the lipid-based carriers have been purified by at least one purification step. Such a purification step may be selected from at least one step of tangential flow filtration and/or at least one step of clarification and/or at least one step of filtration.

The term "purified lipid-based carrier" as used herein has to be understood as lipid-based carriers comprising the RNA, optionally encapsulating the RNA, which have a higher purity after certain purification steps (e.g. tangential flow filtration, clarification filtration, chromatography steps) as compared to the starting material. Typical impurities that are essentially not present or reduced in purified lipid-based carriers comprise e.g. free lipids, organic solvents, empty lipid-based carriers (without RNA cargo), fused lipid-based carriers (lipid-based carriers exceeding the desired size), small micelles (lipid-based carriers that are smaller than the desired size), lipid-based carriers that do not comprise the desired components (e.g. lacking the aggregation reducing lipid), lipid degradation products etc. Other potential impurities may be derived from the synthesis of the individual lipid compounds. Accordingly, lipid compounds used for formulating the lipid-based carriers have a purity level of at least 80%, at least 90%, or at least 95%. It is desirable for the "degree of lipid-based carrier purity" to be as close as possible to 100%. "Purified lipid-based carriers" as used herein have a degree of purity of more than 75%, 80%, 85%, 90%, 91%, 92%, 93%, 94%, 95%, 96%, 97%, 98% or at least 99%. The degree of purity may for example be determined by an analytical HPLC (to determine contaminations and to determine the lipid ratio in the carrier) or by determining the size and size distribution of the obtained lipid-based carriers (e.g. using DLS, NTA, MFI) or the shape of the lipid carriers (e.g. by EM analysis).

In embodiments, the vaccine of the invention as disclosed herein comprises a buffer. Such a buffer comprises at least one sugar and/or at least one salt and/or at least one buffering agent. In embodiments, the vaccine of the invention as disclosed herein comprises a salt, such as NaCl. In some embodiments, the concentration of the salt is in a range from about 10 mM to about 300 mM, such as about 150 mM. In embodiments, the vaccine of the invention as disclosed herein comprises a sugar, such as a disaccharide, such as sucrose. In embodiments, the vaccine of the invention as disclosed herein comprises a buffering agent, selected from Tris, HEPES, NaPO4 or combinations thereof. In embodiments, the buffering agent is in a concentration ranging from about 0.1 mM to about 100 mM. In embodiments, the vaccine of the invention as disclosed herein has a pH in a range of about pH 7.0 to about pH 8.0, or about pH 7.4. In embodiments, the vaccine of the invention as disclosed herein has an osmolality of about 250 mOsmol/kg to about 450 mOsmol/kg, or of about 335 mOsmol/kg.

Vaccine:

In a third aspect, the present invention provides a vaccine, for example a vaccine against a SARS-CoV-2 (formerly nCoV-2019) coronavirus causing COVID-19 disease. The vaccine may be effective against multiple SARS-CoV-2 coronoaviruses. The vaccine may also be effective against both one or more SARS-CoV-2 coronaviruses and one or more non-coronaviruses (e.g., the vaccine may be effective against both a SARS-CoV-2 virus and an influenza virus).

In embodiments of the fourth aspect, the vaccine comprises at least one nucleic acid (e.g. DNA or RNA), preferably at least one RNA of the first aspect, or the composition of the second aspect.

In other embodiments, the vaccine comprises at least one plasmid DNA or adenovirus DNA as defined in the first aspect.

Notably, embodiments relating to the composition of the second aspect may likewise be read on and be understood as suitable embodiments of the vaccine of the fourth aspect. Also, embodiments relating to the vaccine of the fourth aspect may likewise be read on and be understood as suitable embodiments of the composition of the second aspect. Furthermore, features and embodiments described in the context of the first aspect (the nucleic acid of the invention) have to be read on and have to be understood as suitable embodiments of the composition of the fourth aspect.

The term "vaccine" will be recognized and understood by the person of ordinary skill in the art, and is for example intended to be a prophylactic or therapeutic material providing at least one epitope or antigen, preferably an immunogen. In the context of the invention the antigen or antigenic function is suitably provided by the inventive RNA of the first aspect or the composition of the second aspect (comprising at least one RNA of the first aspect).

In embodiments, the vaccine, or the composition of the second aspect, elicits an adaptive immune response, such as an adaptive immune response against a coronavirus, preferably against SARS-CoV-2 coronavirus.

In embodiments, the vaccine, or the composition of the second aspect, elicits an adaptive immune response, preferably an adaptive immune response against SARS-CoV-2 coronavirus variants selected from BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44. Accordingly, the vaccine is a Coronavirus vaccine against variants selected from BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44.

In preferred embodiments, the vaccine, or the composition of the second aspect, elicits an adaptive immune response, preferably an adaptive immune response against SARS-CoV-2 coronavirus variants selected from BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44.

In preferred embodiments, the vaccine, or the composition of the second aspect, elicits functional antibodies that can effectively neutralize the virus, preferably SARS-CoV-2 coronavirus or a specific variant as specified herein.

In further embodiments, the vaccine, or the composition of the second aspect, elicits mucosal IgA immunity by inducing of mucosal IgA antibodies.

In preferred embodiments, the vaccine, or the composition of the second aspect, elicits functional antibodies that can effectively neutralize the virus, preferably SARS-CoV-2 coronavirus or a specific variant as specified herein.

In further embodiments, the vaccine, or the composition of the second aspect, induces broad, functional cellular T-cell responses against coronavirus, preferably against SARS-CoV-2 coronavirus or a specific variant as specified herein.

In further embodiments, the vaccine, or the composition of the second aspect, induces a well-balanced B cell and T cell response against coronavirus, preferably against SARS-CoV-2 coronavirus or a specific variant as specified herein.

In embodiments, the vaccine as defined herein may further comprise a pharmaceutically acceptable carrier and optionally at least one adjuvant as specified in the context of the second aspect.

Suitable adjuvants in that context may be selected from adjuvants disclosed in claim 17 of WO2016/203025.

In embodiments, the vaccine is a monovalent vaccine.

The terms "monovalent vaccine", "monovalent composition" "univalent vaccine" or "univalent composition" refer to a composition or a vaccine comprising only one antigen or antigen construct from a pathogen. Accordingly, said vaccine or composition comprises one nucleic acid species encoding a single antigen or antigen construct of a single organism. The term "monovalent vaccine" includes the immunization against a single valence. In the context of the invention, a monovalent SARS-CoV-2 coronavirus vaccine or composition would comprise at least one nucleic acid encoding one single antigenic peptide or protein derived from one specific SARS-CoV-2 coronavirus or a specific variant as specified herein.

In embodiments, the vaccine is a polyvalent vaccine comprising a plurality or at least more than one of the nucleic acid species defined in the context of the first aspect. Embodiments relating to a polyvalent composition as disclosed in the context of the second aspect may likewise be read on and be understood as suitable embodiments of the polyvalent vaccine.

The terms "polyvalent vaccine", "polyvalent composition" "multivalent vaccine" or "multivalent composition" refer to a composition or a vaccine comprising antigens from more than one virus (e.g. different SARS-CoV-2 coronavirus isolates/variants), or comprising different antigens or antigen constructs of the same SARS-CoV-2 coronavirus, or any combination thereof. The terms describe that said vaccine or composition has more than one valence. In the context of the invention, a polyvalent SARS-CoV-2 coronavirus vaccine would comprise nucleic acid sequences encoding antigenic peptides or proteins derived from several different SARS-CoV-2 coronavirus (e.g. different SARS-CoV-2 coronavirus isolates) or comprising nucleic acid sequences encoding different antigens or antigen constructs from the same SARS-CoV-2 coronavirus, or a combination thereof.

In embodiments, the polyvalent or multivalent vaccine comprises at least one polyvalent composition as defined in the second aspect.

In some embodiments, the vaccine comprises at least one antagonist of at least one RNA sensing pattern recognition receptor as defined in the second aspect.

The vaccine typically comprises a safe and effective amount of nucleic acid (e.g. DNA or RNA), preferably RNA of the first aspect or composition of the second aspect. As used herein, "safe and effective amount" means an amount of nucleic acid or composition sufficient to significantly induce a positive modification of a disease or disorder related to an infection with coronavirus, preferably SARS-CoV-2 coronavirus. At the same time, a "safe and effective amount" is small enough to avoid serious side-effects. In relation to the nucleic acid, composition, or vaccine of the present invention, the expression "safe and effective amount" means an amount of nucleic acid, composition, or vaccine that is suitable for stimulating the adaptive immune system against coronavirus in such a manner that no excessive or damaging immune reactions (e.g. innate immune responses) are achieved.

A "safe and effective amount" of the nucleic acid, composition, or vaccine as defined above will vary in connection with the particular condition to be treated and also with the age and physical condition of the patient to be treated, the severity of the condition, the duration of the treatment, the nature of the accompanying therapy, of the particular pharmaceutically acceptable carrier used, and similar factors, within the knowledge and experience of the skilled person. Moreover, the "safe and effective amount" of the nucleic acid, the composition, or vaccine may depend from application/delivery route (intradermal, intramuscular, intranasal), application device (jet injection, needle injection, microneedle patch, electroporation device) and/or complexation/formulation (protamine complexation or LNP encapsulation, DNA or RNA). Moreover, the "safe and effective amount" of the nucleic acid, the composition, or the vaccine may depend from the physical condition of the treated subject (infant, pregnant women, immunocompromised human subject etc.).

The vaccine can be used according to the invention for human medical purposes and also for veterinary medical purposes (mammals, vertebrates, or avian species).

The pharmaceutically acceptable carrier as used herein includes the liquid or non-liquid basis of the vaccine. If the vaccine is provided in liquid form, the carrier will be water, typically pyrogen-free water; isotonic saline or buffered (aqueous) solutions, e.g. phosphate, citrate etc. buffered solutions. In embodiments, Ringer-Lactate solution is used as a liquid basis for the vaccine or the composition according to the invention as described in WO2006/122828, the disclosure relating to suitable buffered solutions incorporated herewith by reference. Other solutions used as a liquid basis for the vaccine or the composition, in particular for compositions/vaccines comprising LNPs, comprise sucrose and/or trehalose.

The choice of a pharmaceutically acceptable carrier as defined herein is determined, in principle, by the manner, in which the pharmaceutical composition(s) or vaccine according to the invention is administered. The vaccine is preferably administered locally. Routes for local administration in general include, for example, topical administration routes but also intradermal, transdermal, subcutaneous, or intramuscular injections or intralesional, intracranial, intrapulmonal, intracardial, intraarticular and sublingual injections. In embodiments, composition or vaccines according to the present invention are administered by an intradermal, subcutaneous, or intramuscular route, preferably by injection, which may be needle-free and/or needle injection. Preferred in the context of the invention is intramuscular injection. Compositions/vaccines are therefore formulated in liquid or solid form. The suitable amount of the vaccine or composition according to the invention to be administered can be determined by routine experiments, e.g. by using animal models. Such models include, without implying any limitation, rabbit, sheep, mouse, rat, dog and non-human primate models. Unit dose forms for injection include sterile solutions of water, physiological saline or mixtures thereof. The pH of such solutions should be adjusted to about 7.4.

The vaccine or composition as defined herein may comprise one or more auxiliary substances or adjuvants as defined above to further increase the immunogenicity. A synergistic action of the nucleic acid contained in the composition/vaccine and of an auxiliary substance, which may be optionally co-formulated (or separately formulated) with the vaccine or composition as described above, is achieved thereby. Such immunogenicity increasing agents or compounds may be provided separately (not co-formulated with the vaccine or composition) and administered individually.

In embodiments, the vaccine is provided in lyophilized or spray-dried form (as described in the context of the second aspect). Such a lyophilized or spray-dried vaccine typically comprises trehalose and/or sucrose and is re-constituted in a suitable liquid buffer before administration to a subject. In some aspects, a lyophilized vaccine of the embodiments comprises mRNA of the embodiments complexed with LNPs. In some aspects, a lyophilized composition has a water content of less than about 10%. For example, a lyophilized composition can have a water content of about 0.1% to 10%, 0.1% to 7.5%, or 0.5% to 7.5%, In embodiments, the lyophilized composition has a water content of about 0.5% to about 5.0%.

In embodiments administration of a therapeutically effective amount of the nucleic acid, the composition, or the vaccine to a subject induces a neutralizing antibody titer against SARS-CoV-2 coronavirus in the subject.

In some embodiments, the neutralizing antibody titer is at least 100 neutralizing units per milliliter (NU/mL), at least 500 NU/mL, or at least 1,000 NU/mL.

In some embodiments, detectable levels of the coronavirus antigen are produced in the subject at about 1 to about 72 hours post administration of the nucleic acid, the composition, or the vaccine.

In some embodiments, a neutralizing antibody titer (against coronavirus) of at least 100 NU/ml, at least 500 NU/ml, or at least 1,000 NU/ml is produced in the serum of the subject at about 1 day to about 72 days post administration of the nucleic acid, the composition, the, or the vaccine.

In some embodiments, the neutralizing antibody titer is sufficient to reduce coronavirus infection by at least 50% relative to a neutralizing antibody titer of an unvaccinated control subject or relative to a neutralizing antibody titer of a subject vaccinated with a live attenuated viral vaccine, an inactivated viral vaccine, or a protein subunit viral vaccine.

In some embodiments, the neutralizing antibody titer and/or a T cell immune response is sufficient to reduce the rate of asymptomatic viral infection relative to the neutralizing antibody titer of unvaccinated control subjects.

In some embodiments, the neutralizing antibody titer and/or a T cell immune response is sufficient to prevent viral latency in the subject.

In some embodiments, the neutralizing antibody titer is sufficient to block fusion of virus with epithelial cells of the subject.

In some embodiments, the neutralizing antibody titer is induced within 20 days following a single 1 ug-100 ug dose of the nucleic acid, the composition, or the vaccine, or within 40 days following a second 1 ug-100 μg dose of the nucleic acid, the composition, or the vaccine.

In embodiments, administration of a therapeutically effective amount of the nucleic acid, the composition, the or the vaccine to a subject induces a T cell immune response against coronavirus in the subject. In preferred embodiments, the T cell immune response comprises a CD4+ T cell immune response and/or a CD8+ T cell immune response.

Kit or Kit of Parts, Application, Medical Uses, Method of Treatment:

In a fourth aspect, the present invention provides a kit or kit of parts suitable for treating or preventing a coronavirus infection. In embodiments, said kit or kit of parts is suitable for treating or preventing a coronavirus, preferably a SARS-CoV-2 (formerly nCoV-2019) coronavirus infection.

Notably, embodiments relating to the nucleic acid of the first aspect, the composition of the second aspect, and the vaccine of the third aspect, may likewise be read on and be understood as suitable embodiments of the kit or kit of parts of the fourth aspect of the invention.

In embodiments, the kit or kit of parts comprises at least one nucleic acid (e.g. RNA or DNA), preferably at least one RNA of the first aspect, at least one composition of the second aspect, and/or at least one vaccine of the third aspect.

In embodiments, the kit or kit of parts comprises at least one DNA as defined in the first aspect, e.g. at least one plasmid DNA and/or at least one adenovirus DNA.

In addition, the kit or kit of parts may comprise a liquid vehicle for solubilising, and/or technical instructions providing information on administration and dosage of the components.

The kit may further comprise additional components as described in the context of the composition of the second aspect, and/or the vaccine of the fourth aspect.

The technical instructions of said kit may contain information about administration and dosage and patient groups. Such kits, including kits of parts, may be applied e.g. for any of the applications or uses mentioned herein, such as for the use of the nucleic acid of the first aspect, the composition of the second aspect, the polypeptide of the third aspect, or the vaccine of the fourth aspect, for the treatment or prophylaxis of an infection or diseases caused by a coronavirus, preferably SARS-CoV-2 coronavirus, or disorders related thereto.

IN embodiments, the nucleic acid, the composition, or the vaccine is provided in a separate part of the kit, wherein the nucleic acid, the composition, or the vaccine is preferably lyophilised.

The kit may further contain as a part a vehicle (e.g. buffer solution) for solubilising the nucleic acid, the composition, or the vaccine.

In embodiments, the kit or kit of parts as defined herein comprises Ringer lactate solution.

In embodiments, the kit or kit of parts as defined herein comprises a multidose container for administration of the composition/the vaccine.

Any of the above kits may be used in a treatment or prophylaxis as defined herein. In embodiments, any of the above kits may be used as a vaccine, such as a vaccine against infections caused by a coronavirus, including those caused by SARS-CoV-2 coronavirus.

In embodiments, the kit or kit of parts comprises the following components:
a) at least one container or vial comprising a composition or SARS-CoV-2 vaccine as defined herein, wherein the composition or SARS-CoV-2 vaccine has a nucleic acid concentration, such as an RNA concentration in a range of about 100 μg/ml to about 1 mg/ml, or in a range of about 100 μg/ml to about 500 μg/ml, e.g. about 270 μg/ml.
b) at least one dilution container or vial comprising a sterile dilution buffer, suitably a buffer comprising NaCl, optionally comprising a preservative;
c) at least one means for transferring the composition or vaccine from the storage container to the dilution container; and
d) at least one syringe for administering the final diluted composition or vaccine to a subject, preferably configured for intramuscular administration to a human subject, wherein the final diluted composition or vaccine has a nucleic acid concentration, such as an RNA concentration in a range of about 10 μg/ml to about 100 μg/ml, or in a range of about 10 μg/ml to about 50 μg/ml, e.g. about 24 μg/ml.

In an embodiment, the kit or kit of parts comprises more than one mRNA-based SARS-CoV-2 composition/vaccine, preferably:

at least one vaccine as defined herein provided in a first vial or container, wherein the vaccine comprises at least one nucleic acid, preferably RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NOs: 127-137, preferably formulated in lipid nanoparticles (LNPs), which have a molar ratio of approximately 50:10:38.5:1.5, or 47.5:10:40.8:1.7 or 47.4:10:40.9:1.7 or 47.5:10:40.7:1.8 proportion (mol %) of ionizable cationic lipid III-3 (ALC-0315), DSPC, cholesterol and PEG-lipid of formula (IVa) (with n=49 or with n=45 (ALC-0159)). In embodiments, the nucleic acid, such as mRNA is chemically modified. In embodiments, the nucleic acid, such as mRNA is not chemically modified; and/or at least one vaccine as defined herein provided in a first vial or container, wherein the vaccine comprises at least one nucleic acid, such as RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NOs: 177-182, preferably formulated in lipid nanoparticles (LNPs), which have a molar ratio of approximately 50:10:38.5:1.5, or 47.5:10:40.8:1.7 or 47.4:10:40.9:1.7 or 47.5:10:40.7:1.8 proportion (mol %) of ionizable cationic lipid III-3 (ALC-0315), DSPC, cholesterol and PEG-lipid of formula (IVa) (with n=49 or with n=45

(ALC-0159)); in embodiments, the nucleic acid, such as mRNA is chemically modified. In embodiments, the nucleic acid, such as mRNA is not chemically modified; and/or at least one vaccine as defined herein provided in a first vial or container, wherein the vaccine comprises at least one nucleic acid, such as mRNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NOs: 240-258, preferably formulated in lipid nanoparticles (LNPs), which have a molar ratio of approximately 50:10:38.5:1.5, or 47.5:10:40.8:1.7 or 47.4:10:40.9:1.7 or 47.5:10:40.7:1.8 proportion (mol %) of ionizable cationic lipid III-3 (ALC-0315), DSPC, cholesterol and PEG-lipid of formula (IVa) (with n=49 or with n=45 (ALC-0159)); in embodiments, the nucleic acid, such as mRNA is chemically modified. In embodiments, the nucleic acid, such as mRNA is not chemically modified; and/or at least one vaccine as defined herein provided in a first vial or container, wherein the vaccine comprises at least one nucleic acid, such as RNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NOs: 303-315, preferably formulated in lipid nanoparticles (LNPs), which have a molar ratio of approximately 50:10:38.5:1.5, or 47.5:10:40.8:1.7 or 47.4:10:40.9:1.7 or 47.5:10:40.7:1.8 proportion (mol %) of ionizable cationic lipid III-3 (ALC-0315), DSPC, cholesterol and PEG-lipid of formula (IVa) (with n=49 or with n=45 (ALC-0159)); in embodiments, the nucleic acid, such as mRNA is chemically modified. In embodiments, the nucleic acid, such as mRNA is not chemically modified; and/or at least one further vaccine as defined herein provided in a first vial or container, wherein the composition/vaccine comprises at least one nucleic acid, such as mRNA, which is identical or at least 70%, 80%, 85%, 86%, 87%, 88%, 89%, 90%, 91%, 92%, 93%, 94%, 95%, 96%, 97%, 98%, or 99% identical to a nucleic acid sequence of SEQ ID NOs: 139-158 preferably formulated in lipid nanoparticles (LNPs), which have a molar ratio of approximately 50:10:38.5:1.5, or 47.5:10:40.8:1.7 or 47.4:10:40.9:1.7 or 47.5:10:40.7:1.8 proportion (mol %) of ionizable cationic lipid III-3 (ALC-0315), DSPC, cholesterol and PEG-lipid of formula (IVa) (with n=49 or with n=45 (ALC-0159)); in embodiments, the nucleic acid, such as mRNA is chemically modified. In embodiments, the nucleic acid, such as mRNA is not chemically modified.

In embodiments, the kit additionally comprises syringes for injecting the composition or vaccine. In that context, the syringe for injecting the pharmaceutical composition, or the vaccine are selected from syringes as described in published PCT patent application WO2022207862, in particular, characterized by any one of the features of claims 70 to 83. The whole disclosure of WO2022207862, in particular the disclosure relating to claims 1 to 83, or the disclosure relating to claims 70 to 83 are herewith incorporated by reference.

In another aspect, the invention relates to a pre-filled syringe containing the nucleic acid/RNA of the first aspect, the composition of the second aspect, the vaccine of the third aspect. In embodiments, the pre-filled syringe is selected from syringes as described in published PCT patent application WO2022207862, in particular, characterized by any one of the features of claims 70 to 83. The whole disclosure of WO2022207862, in particular the disclosure relating to claims 1 to 83, or the disclosure relating to claims 70 to 83 are herewith incorporated by reference. In embodiments in that context, the pre-syringe is a syringe for injection and contains the pharmaceutical composition or the vaccine, wherein the syringe is characterized in that the inner surface of the syringe barrel is essentially free or free of silicone oils and/or the syringe plunger stopper is essentially free or free of silicone oils.

Combination:

A fifth aspect relates to a combination of at least two nucleic acid sequences as defined in the first aspect, at least two compositions as defined in the context of the second aspect, at least two vaccines as defined in the context of the third aspect, or at least two kits as defined in the fourth aspect.

In the context of the present invention, the term "combination" means a combined occurrence of at least two components, such as at least two nucleic acid sequences as defined in the first aspect, at least two compositions as defined in the context of the second aspect, at least two vaccines as defined in the context of the third aspect, or at least two kits as defined in the fourth aspect. The components of such a combination may occur as separate entities.

Thus, the administration of the components of the combination may occur either simultaneously or timely staggered, either at the same site of administration or at different sites of administration.

Notably, embodiments relating to the nucleic acid of the first aspect, the composition of the second aspect, the vaccine of the third aspect, or the kit or kit of parts of the fourth aspect may likewise be read on and be understood as suitable embodiments of the components of the combination of the fifth aspect.

In embodiments, the combination may comprise a plurality or at least more than one of the nucleic acid species, e.g. RNA species as defined in the context of the first aspect of the invention, wherein the nucleic acid species are provided as separate components.

In embodiments, the combination as defined herein may comprise 2, 3, 4, 5, 6, 7, 8, 9, or 10 or more different nucleic acids e.g. RNA species as defined in the context of the first aspect of the invention; 2, 3, 4, 5, 6, 7, 8, 9, or 10 different compositions as defined in the context of the second aspect of the invention; 2, 3, 4, 5, 6, 7, 8, 9, or 10 different vaccines as defined in the context of the third aspect of the invention, wherein the nucleic acid species, compositions, vaccines are provided as separate components.

In embodiments, the combination comprises 2, 3, 4 or 5 RNAs comprised in separate components, such as RNA species, wherein said nucleic acid species comprise or consist of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of SEQ ID NOs: 102-112, 127-137, 171-176, 177-182, 221-239, 240-258, 260, 261, 263, 290-302, 303-315 and, optionally, at least one pharmaceutically acceptable carrier or excipient, wherein each of the 2, 3, 4 or 5 nucleic acid species encode a different antigenic peptide or protein of a SARS-CoV-2 coronavirus.

In the following, preferred embodiments of a combination are provided, wherein each component of the combination is provided as separate entities.

In embodiments, the at least 2, 3, 4, 5, 6, 7, 8, 9, 10 or even more different nucleic acid species, compositions, vaccines of the combination each encode a different prefusion stabilized spike protein (as defined in the first aspect). Preferably, stabilization of the prefusion conformation is obtained by introducing two consecutive proline substitutions at residues K986 and V987 in the spike protein (Amino acid positions according to reference SEQ ID NO: 1).

Accordingly, in preferred embodiments, the at least 2, 3, 4, 5, 6, 7, 8, 9, 10 pre-fusion stabilized spike proteins (S_stab) each comprises at least one pre-fusion stabilizing mutation, wherein the at least one pre-fusion stabilizing mutation comprises the following amino acid substitutions: K986P and V987P (amino acid positions according to reference SEQ ID NO: 1).

Accordingly, the at least 2, 3, 4, 5, 6, 7, 8, 9, 10 or even more different nucleic acid species, compositions, vaccines of the combination each encode a different prefusion stabilized spike protein, wherein the at least 2, 3, 4, 5, 6, 7, 8, 9, 10 or even more stabilized spike proteins are selected from amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 45-55, 159-164, 183-201, 264-276 or an immunogenic fragment or immunogenic variant of any of these.

In embodiments, the combination comprises one nucleic acid species, composition, vaccine comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 10, wherein the multivalent composition additionally comprises at least 2, 3, 4 further RNA species selected from i) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 45, ii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 46;

iii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 47;

iv) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 48;

v) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 49;

vi) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 50;

vii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 51;

viii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 52;

ix) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 53, x) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 54, xi) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 55, xii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 159, xiii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 160;

xiv) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 161;

xv) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 162;

xvi) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 163;

xvii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 164;

xviii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 183;

xix) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 184;

xx) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 185;

xxi) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 186;

xxii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 187;

xxiii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 188;

xxiv) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 189;

xxv) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 190;

xxvi) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 191;

xxvii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 192;

xxviii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 193;

xxix) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 194;

xxx) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 195;

xxxi) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 196;

xxxii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 197;

xxxiii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 198;

xxxiv) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 199;

xxxv) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 200;

xxvi) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 201;

xxvii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 264;

xxviii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 265;

xxix) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 266;

xxx) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 267;

xxxi) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 268;

xxxii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 269;

xxxiii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 270;

xxxiv) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 271;

xxxv) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 272;

xxxvi) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 273;

xxxvii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 274;

xxxviii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 275; and xxxix) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 276.

In embodiments, the combination comprises one nucleic acid species, composition, vaccine comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 56, wherein the multivalent composition additionally comprises at least 1, 2, 3, 4 further RNA species selected from i) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 45, ii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 46;

iii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 47;

iv) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 48;

v) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 49;

vi) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 50;

vii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 51;

viii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 52;

ix) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 53, x) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 54, xi) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 55, xii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 159, xiii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 160;

xiv) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 161;

xv) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 162;

xvi) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 163;

xvii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 164;

xviii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 183;

xix) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 184;

xx) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 185;

xxi) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 186;

xxii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 187;

xxiii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 188;

xxiv) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 189;

xxv) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 190;

xxvi) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 191;

xxvii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 192;

xxviii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 193;

xxix) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 194;

xxx) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 195;

xxxi) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 196;

xxxii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 197;

xxxiii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 198;

xxxiv) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 199;

xxxv) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 200;

xxvi) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 201;

xxvii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 264;

xxviii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 265;

xxix) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 266;

xxx) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 267;

xxxi) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 268;

xxxii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 269;

xxxiii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 270;

xxxiv) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 271;

xxxv) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 272;

xxxvi) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 273;

xxxvii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 274;

xxxviii) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 275; and xxxix) one nucleic acid species comprises a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 276.

Preferably, the at least 2, 3, 4, 5, 6, 7, 8, 9, 10 or even more different nucleic acid species, composition, vaccine of the combination comprise nucleic acid coding sequences each encoding a different prefusion stabilized spike protein, wherein the at least 2, 3, 4, 5, 6, 7, 8, 9, 10 or even more nucleic acid coding sequences are selected from nucleic acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 68-158, 165-182, 202-258, 277-315 or fragments or variants of any of these. Preferably, each of the mRNA species comprise a cap1 structure, and, optionally, each of the mRNA species do not comprise modified nucleotides.

In a specific embodiment, a first component of the combination comprises a viral vector vaccine/composition, such as an adenovirus vector based vaccine, e.g., ADZ1222 or Ad26.COV-2.S, and a second component comprises a nucleic acid based vaccine/composition, preferably an mRNA-based vaccine as defined herein.

First and Second/Further Medical Use:

A further aspect relates to the first medical use of the provided nucleic acid, composition, vaccine, kit, or combination.

Notably, embodiments relating to the nucleic acid of the first aspect, the composition of the second aspect, the vaccine of the third aspect, or the kit or kit of parts of the fourth aspect or the syringe, or the combination of the fifth aspect may likewise be read on and be understood as suitable embodiments of medical uses of the invention.

Accordingly, the invention provides at least one nucleic acid (e.g. DNA or RNA), such as RNA as defined in the first aspect for use as a medicament, the composition as defined in the second aspect for use as a medicament, the vaccine as defined in the third aspect for use as a medicament, and the kit or kit of parts as defined in the fourth aspect for use as a medicament, and the combination for use as a medicament.

The invention further provides at least one nucleic acid (e.g. DNA or RNA), preferably RNA as defined in the first aspect for use for the preparation of a medicament, the composition as defined in the second aspect for use for the preparation of a medicament, the vaccine as defined in the third aspect for use for the preparation of a medicament, and the kit or kit of parts as defined in the fourth aspect for use for the preparation of a medicament, and the combination for use for the preparation of a medicament.

The invention further provides the use of at least one nucleic acid (e.g. DNA or RNA), preferably RNA as defined in the first aspect for the preparation of a medicament, of the composition as defined in the second aspect for the preparation of a medicament, of the vaccine as defined in the third aspect for the preparation of a medicament, of the kit or kit of parts as defined in the fourth aspect for the preparation of a medicament, and of the combination for the preparation of a medicament.

The present invention furthermore provides several applications and uses of the nucleic acid, composition, vaccine, or kit, or combination.

In embodiments, nucleic acid (preferably RNA), composition, vaccine, or kit, or combination may be used for human medical purposes and also for veterinary medical purposes, preferably for human medical purposes.

In embodiments, nucleic acid (preferably RNA), composition, vaccine, or kit or kit of parts or combination is for use as a medicament for human medical purposes, wherein said nucleic acid (preferably RNA), composition, vaccine, or kit or kit of parts may be suitable for young infants, newborns, immunocompromised recipients, as well as pregnant and breast-feeding women and elderly people. In embodiments, nucleic acid (preferably RNA), composition, vaccine, or kit or kit of parts is for use as a medicament for human medical purposes, wherein said nucleic acid (preferably RNA), composition, vaccine, or kit or kit of parts is particularly suitable for elderly human subjects.

Said nucleic acid (preferably RNA), composition, vaccine, or kit or combination are for use as a medicament for human medical purposes, wherein said RNA, composition, vaccine, or the kit or kit of parts is suitable for intramuscular injection or intradermal injection.

In yet another aspect, the invention relates to the second medical use of the provided nucleic acid, composition, vaccine, or kit or combination.

Accordingly, the invention provides at least one nucleic acid, preferably RNA as defined in the first aspect for treatment or prophylaxis of an infection with a coronavirus, preferably SARS-CoV-2 coronavirus, or a disorder or a disease related to such an infection, such as COVID-19; a composition as defined in the second aspect for treatment or prophylaxis of an infection with a coronavirus, preferably SARS-CoV-2 coronavirus, or a disorder or a disease related to such an infection, such as COVID-19; a vaccine as defined in the third aspect for treatment or prophylaxis of an infection with a coronavirus, preferably SARS-CoV-2 coronavirus, or a disorder or a disease related to such an infection, such as COVID-19; a kit or kit of parts as defined in the fourth aspect for treatment or prophylaxis of an infection with a coronavirus, preferably SARS-CoV-2 coronavirus, or a disorder or a disease related to such an infection, such as COVID-19; a combination as defined in the fifth aspect for treatment or prophylaxis of an infection with a coronavirus, preferably SARS-CoV-2 coronavirus, or a disorder or a disease related to such an infection, such as COVID-19.

In embodiments, the nucleic acid, preferably RNA of the first aspect, the composition of the second aspect, the vaccine of the third aspect, or the kit or kit of parts of the fourth aspect, or the combination of the fifth aspect, is for use in the treatment or prophylaxis of an infection with a coronavirus, preferably with SARS-CoV-2 coronavirus.

In preferred embodiments, the SARS-CoV-2 coronavirus infection is an infection with at least one Coronavirus variant selected from (but not limited to) BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44.

Accordingly, the invention provides at least one nucleic acid, preferably RNA, at least one composition, vaccine, the kit or kit of parts, or a combination for treatment or prophylaxis of an infection with at least one Coronavirus variant selected from (but not limited to) BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44.

In embodiments, the nucleic acid, preferably RNA of the first aspect, the composition of the second aspect, the vaccine of the third aspect, or the kit or kit of parts of the fourth aspect, or the combination of the fifth aspect, may be used in a method of prophylactic (pre-exposure prophylaxis or post-exposure prophylaxis) and/or therapeutic treatment of infections caused by a coronavirus, preferably SARS-CoV-2 coronavirus.

In embodiments, the nucleic acid, preferably RNA of the first aspect, the composition of the second aspect, the polypeptide of the third aspect, the vaccine of the third aspect, or the kit or kit of parts of the fourth aspect, or the combination of the fifth aspect may be used in a method of prophylactic (pre-exposure prophylaxis or post-exposure prophylaxis) and/or therapeutic treatment of COVID-19 disease caused by a SARS-CoV-2 coronavirus infection.

The nucleic acid, the composition, or the vaccine, or the combination may be administered locally. In embodiments, compositions or vaccines or combinations may be administered by an intradermal, subcutaneous, intranasal, or intramuscular route. In embodiments, the inventive nucleic acid, composition, vaccine may be administered by conventional needle injection or needle-free jet injection. Preferred in that context is intramuscular injection.

In embodiments where plasmid DNA is used and comprised in the composition or vaccine or combination, the composition/vaccine/combination may be administered by electroporation using an electroporation device, e.g. an electroporation device for intradermal or intramuscular delivery. Suitably, a device as described in U.S. Pat. No. 7,245,963B2 may be used, such as a device as defined by claims 1 to 68 of U.S. Pat. No. 7,245,963B2.

In embodiments where adenovirus DNA is used and comprised in the composition or vaccine or combination, the composition/vaccine/combination may be administered by intranasal administration.

In embodiments, the nucleic acid as comprised in a composition or vaccine or combination as defined herein is provided in an amount of about 100 ng to about 500 µg, in an amount of about 1 µg to about 200 µg, in an amount of about 1 µg to about 100 µg, in an amount of about 5 µg to about 100 µg, in an amount of about 10 µg to about 50 µg, in an amount of about 1 µg, 2 µg, 3 µg, 4 µg, 5 µg, 8 µg, 9 µg, 10 µg, 11 µg, 12 µg, 13 µg, 14 µg, 15 µg, 16 µg 20 µg, 25 µg, 30 µg, 35 µg, 40 µg, 45 µg, 50 µg, 55 µg, 60 µg, 65 µg, 70 µg, 75 µg, 80 µg, 85 µg, 90 µg, 95 µg or 100 µg.

In some embodiments, the vaccine comprising the nucleic acid, or the composition comprising the nucleic acid is formulated in an effective amount to produce an antigen specific immune response in a subject. In some embodiments, the effective amount of nucleic acid is a total dose of 1 µg to 200 µg, 1 µg to 100 µg, or 5 µg to 100 µg.

In one embodiment, the immunization protocol for the treatment or prophylaxis of a subject against coronavirus, preferably SARS-CoV-2 coronavirus comprises one single doses of the composition or the vaccine.

In some embodiments, the effective amount is a dose of 1 µg administered to the subject in one vaccination. In some embodiments, the effective amount is a dose of 2 µg administered to the subject in one vaccination. In some embodiments, the effective amount is a dose of 3 µg administered to the subject in one vaccination. In some embodiments, the effective amount is a dose of 4 µg administered to the subject in one vaccination. In some embodiments, the effective amount is a dose of 5 µg administered to the subject in one vaccination. 6 µg administered to the subject in one vaccination. In some embodiments, the effective amount is a dose of 7 µg administered to the subject in one vaccination. In some embodiments, the effective amount is a dose of 8 µg administered to the subject in one vaccination. In some embodiments, the effective amount is a dose of 9 µg administered to the subject in one vaccination. In some embodiments, the effective amount is a dose of 10 µg administered to the subject in one vaccination. In some embodiments, the effective amount is a dose of 11 µg administered to the subject in one vaccination. In some embodiments, the effective amount is a dose of 12 µg administered to the subject in one vaccination. In some embodiments, the effective amount is a dose of 13 µg administered to the subject in one vaccination. In some embodiments, the effective amount is a dose of 14 µg administered to the subject in one vaccination. In some embodiments, the effective amount is a dose of 16 µg administered to the subject in one vaccination. In some embodiments, the effective amount is a dose of 20 µg administered to the subject in one vaccination. In some embodiments, the effective amount is a dose of 25 µg administered to the subject in one vaccination. In some embodiments, the effective amount is a dose of 30 µg administered to the subject in one vaccination. In some embodiments, the effective amount is a dose of 40 µg administered to the subject in one vaccination. In some embodiments, the effective amount is a dose of 50 µg administered to the subject in one vaccination. In some embodiments, the effective amount is a dose of 100 µg administered to the subject in one vaccination. In some embodiments, the effective amount is a dose of 200 µg administered to the subject in one vaccination. A "dose" in that context relates to the effective amount of nucleic acid, preferably mRNA as defined herein.

In preferred embodiments, the immunization protocol for the treatment or prophylaxis of a coronavirus, preferably a SARS-CoV-2 coronavirus infection comprises a series of single doses or dosages of the composition or the vaccine.

A single dosage, as used herein, refers to the initial/first dose, a second dose or any further doses, respectively, which are administered to "boost" the immune reaction.

In some embodiments, the effective amount is a dose of 1 µg administered to the subject a total of two times. In some embodiments, the effective amount is a dose of 2 µg administered to the subject a total of two times. In some embodiments, the effective amount is a dose of 3 µg administered to the subject a total of two times. In some embodiments, the effective amount is a dose of 4 µg administered to the subject a total of two times. In some embodiments, the effective amount is a dose of 5 µg administered to the subject a total of two times. In some embodiments, the effective amount is a dose of 6 µg administered to the subject a total of two times. In some embodiments, the effective amount is a dose of 7 µg administered to the subject a total of two times. In some embodiments, the effective amount is a dose of 8 µg administered to the subject a total of two times. In some embodiments, the effective amount is a dose of 9 µg administered to the subject a total of two times. In some embodiments, the effective amount is a dose of 10 µg administered to the subject a total of two times. In some embodiments, the effective amount is a dose of 11 µg administered to the subject a total of two times. In some embodiments, the effective amount is a dose of 12 µg administered to the subject a total of two times. In some embodiments, the effective amount is a dose of 13 µg administered to the subject a total of two times. In some embodiments, the effective amount is a dose of 14 µg administered to the subject a total of two times. In some embodiments, the effective amount is a dose of 16 µg administered to the subject a total of two times. In some embodiments, the effective amount is a dose of 20 µg administered to the subject a total of two times. In some embodiments, the effective amount is a dose of 25 µg administered to the subject a total of two times. In some embodiments, the effective amount is a dose of 30 µg administered to the subject a total of two times. In some embodiments, the effective amount is a dose of 40 µg administered to the subject a total of two times. In some embodiments, the effective amount is a dose of 50 µg administered to the subject a total of two times. In some embodiments, the effective amount is a dose of 100 µg administered to the subject a total of two times. In some embodiments, the effective amount is a dose of 200 µg administered to the subject a total of two times. A "dose" in that context relates to the effective amount of nucleic acid, preferably mRNA as defined herein.

In embodiments, the vaccine/composition/combination immunizes the subject against a coronavirus, preferably against a SARS-CoV-2 coronavirus infection (upon administration as defined herein) for at least 1 year, or at least 2 years. In embodiments, the vaccine/composition/combination immunizes the subject against a coronavirus, preferably against a SARS-CoV-2 coronavirus for more than 2 years, for more than 3 years, for more than 4 years, or for more than 5-10 years.

Method of Treatment and Use, Diagnostic Method and Use:

In another aspect, the present invention relates to a method of treating or preventing a disorder.

Notably, embodiments relating to the nucleic acid, preferably the RNA of the first aspect, the composition of the second aspect, the vaccine of the third aspect, or the kit or kit of parts of the fourth aspect or the syringe, or the combination of the fifth aspect, or medical uses may likewise be read on and be understood as suitable embodiments of methods of treatments as provided herein. Furthermore, specific features and embodiments relating to method of treatments as provided herein may also apply for medical uses of the invention.

Preventing (Inhibiting) or treating a disease, in particular a coronavirus infection relates to inhibiting the full development of a disease or condition, for example, in a subject who is at risk for a disease such as a coronavirus infection. "Treatment" refers to a therapeutic intervention that ameliorates a sign or symptom of a disease or pathological condition after it has begun to develop. The term "ameliorating", with reference to a disease or pathological condition, refers to any observable beneficial effect of the treatment. Inhibiting a disease can include preventing or reducing the risk of the disease, such as preventing or reducing the risk of viral infection. The beneficial effect can be evidenced, for example, by a delayed onset of clinical symptoms of the disease in a susceptible subject, a reduction in severity of some or all clinical symptoms of the disease, a slower progression of the disease, a reduction in the viral load, an improvement in the overall health or well-being of the subject, or by other parameters that are specific to the particular disease. A "prophylactic" treatment is a treatment administered to a subject who does not exhibit signs of a disease or exhibits only early signs for the purpose of decreasing the risk of developing pathology.

In embodiments, the present invention relates to a method of treating or preventing a disorder, wherein the method comprises applying or administering to a subject in need thereof at least one nucleic acid of the first aspect, the composition of the second aspect, the vaccine of the third aspect, or the kit or kit of parts of the fourth aspect, or the combination of the fifth aspect.

In embodiments, the disorder is an infection with a coronavirus, or a disorder related to such infections, such as an infection with SARS-CoV-2 coronavirus, or a disorder related to such infections, e.g. COVID-19.

In preferred embodiments, the disorder is an infection with SARS-CoV-2 coronavirus variant selected from (but not limited to) BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44.

In embodiments, the present invention relates to a method of treating or preventing a disorder as defined above, wherein the method comprises applying or administering to a subject in need thereof at least one nucleic acid of the first aspect, the composition of the second aspect, the vaccine of the third aspect, or the kit or kit of parts of the fourth aspect, or the combination of the fifth aspect, wherein the subject in need of treatment. In embodiments the subject is a mammalian subject.

In certain embodiments, a method of treating or preventing disease by applying or administering to a subject in need thereof at least one nucleic acid of the first aspect, the composition of the second aspect, the vaccine of the third aspect, or the kit or kit of parts of the fourth aspect, or the combination of the fifth aspect, is further defined as a method of reducing disease burden in the subject. For example, the method preferably reduces the severity and/or duration of one or more symptom of COVID-19 disease. In some aspects, a method reduces the probability that a subject will require hospital admission, intensive care unit admission, treatment with supplemental oxygen and/or treatment with a ventilator. In further aspects, the method reduces the probability that a subject will develop a fever, breathing difficulties; loss of smell and/or loss of taste. In preferred aspects, the method reduces the probability that a subject will develop severe or moderate COVID-19 disease. In certain aspects, a method of the embodiments prevents severe or moderate COVID-19 disease in the subject between about 2 weeks and 1 month, 2 months, 3 months, 4 months, 5 months, 6 months, 1 year or 2 years after the subject is administered a composition of the embodiments. In aspects, a method of the embodiments prevents symptomatic COVID-19 disease. In further aspects, a method of the embodiment prevents detectable levels of SARS-CoV-2 nucleic acid in the subject between about 2 weeks and 1 month, 2 months, 3 months, 4 months, 5 months, 6 months, 1 year or 2 years after the subject is administered a composition of the embodiments. In further aspects, a method of the embodiments is defined as a method for providing protective immunity to a coronavirus infection (e.g., SARS-CoV-2 infection) in the subject. In still further aspects, a method of the embodiments prevents moderate and severe COVID-19 disease in at least 80%, 85%, 90% or 95% of treated subjects. In yet further aspects, a method of the embodiments prevents moderate and severe COVID-19 disease in at least 80%, 85%, 90% or 95% of treated subjects from about 2 weeks to about 1 year after administering the second or subsequent immunogenic composition (e.g., a booster administration). In yet further aspects, a method of the embodiments prevents moderate and severe COVID-19 disease in at least 80%, 85%, 90% or 95% of treated subjects from about 2 weeks to about 3 month, 6 months, 9 months, 1 year, 1.5 years, 2 years or 3 years after administering the second or subsequent composition.

In a further aspect, a method of the embodiments comprises (i) obtaining a composition (e.g., a vaccine composition) of the embodiments, wherein the composition is lyophilized; (ii) solubilizing the lyophilized composition in a pharmaceutically acceptable liquid carrier to produce a liquid composition; and (iii) administering an effective amount of the liquid composition to the subject. In some aspects, the lyophilized composition comprises less than about 10% water content. For example, the lyophilized composition can comprise about 0.1% to about 10%, 0.5% to 7.5% or 0.5% to 5.0% water.

In still further aspects, a method of the embodiments comprises administering a vaccine composition comprising at least two different mRNAs, each mRNA encoding a different SARS-CoV-2 spike polypeptide that are each at least about 95% identical to SEQ ID NO: 2 (e.g., in complex with an LNP) to a subject. In further aspects, such a method provides a sufficient immune response in the subject to protect the subject from severe COVID-19 disease for at least about 6 months. For example, in some aspects, the subject is protected from severe COVID-19 disease for about 6 months to about 1 year, 1.5 years, 2 years, 2.5 years, 3 years, 4 years or 5 years. Thus, in some aspects, a method of the embodiments provides a single dose vaccine composition that can provide prolonged (e.g., greater than 6 months of) protection from severe disease to a subject.

As used herein severe COVID-19 disease is defined as a subject experiencing one or more of the following:
Clinical signs at rest indicative of severe systemic illness (respiratory rate ≥30 breaths per minute, heart rate ≥125 per minute, SpO2≤93% on room air at sea level or PaO2/FIO2<300 mm Hg (adjusted according to altitude))
Respiratory failure (defined as needing high flow-oxygen, non-invasive ventilation, mechanical ventilation or ECMO)
Evidence of shock (SBP <90 mm Hg, DBP <60 mmHg, or requiring vasopressors)
Significant renal, hepatic, or neurologic dysfunction
Admission to ICU
Death.

As used herein moderate COVID-19 disease is defined as a subject experiencing one or more of the following:
Shortness of breath or difficulty breathing
Respiratory rate ≥20 breaths per minute
Abnormal SpO2 but still >93% on room air at sea level (adjusted according to altitude)
Clinical or radiographic evidence of lower respiratory tract disease
Radiologic evidence of deep vein thrombosis (DVT).

As used herein mild COVID-19 disease is defined as a subject experiencing all of the following:
Symptomatic AND
No shortness of breath or difficulty breathing AND
No hypoxemia (adjusted according to altitude) AND
Does not meet the case definition of moderate or severe COVID-19 disease.

In embodiments, the subject in need is a mammalian subject, preferably a human subject, e.g. newborn, pregnant, immunocompromised, and/or elderly. In some embodiments, the subject between the ages of 6 months and 100 years, 6 months and 80 years, 1 year and 80 years, 1 year and 70 years, 2 years and 80 years or 2 years and 60 years. In other embodiments the subject is a new-born or infant of an age of not more than 3 years, of not more than 2 years, of not more than 1.5 years, of not more than 1 year (12 months), of not more than 9 months, 6 months or 3 months.

In certain embodiments, the human subject is an elderly human subject. In some other embodiments the subject is an elderly subject of an age of at least 50, 60, 65, or 70 years. In further aspects, a subject for treatment according to the embodiments is 61, 62, 63, 64, 65 years of age or older. In still further aspects, the subject is 18 years old to 60 years old. In still further aspects, the subject is 18 years old to 65 years old.

In further embodiments, the mammalian subject is a human subject is 60 years of age or less. In certain embodiments the human subject is human subject is 55, 50, 45 or 40 years of age or less. In some further embodiments, the mammalian subject is a human subject is 65 years of age or less. In certain embodiments the human subject is human subject is 60, 55, 50, 45 or 40 years of age or less. Thus, in some embodiments, is the human subject is between about 12 and 65, 12 and 60; 12 and 55; 12 and 50; 12 and 45; or 12 and 40 years of age.

In further embodiments the human subject is between about 18 and 65, 18 and 60; 18 and 55; 18 and 50; 18 and 45; or 18 and 40 years of age. In some embodiments the human subject is 18 to 50 or 18 to 40 years of age.

In certain embodiments, a subject for treatment according to the embodiments is a pregnant subject, such a pregnant human. In some aspects, the subject has been pregnant for more than about one month, two months, three months, four months, five months, six months, seven months or eight months.

In further aspects, a subject for treatment according to the embodiments has a disease or is immune compromised.

In some aspects, the subject has liver disease, kidney disease diabetes, hypertension, heart disease or lung disease.

In further aspects, a subject for treatment according to the embodiments is a subject with history of allergic reaction, such a subject having food allergies. In some aspect, the subject has had a previous allergic reaction to a vaccine, such as an anaphylactic reaction. In still further aspects, a subject for treatment according to the methods is a subject having detectable anti-PEG antibodies, such as detectable anti-PEG IgE in the serum.

In embodiments, such the method of treatment may comprise the steps of:
a) providing at least one nucleic acid (e.g. DNA or RNA), preferably at least one RNA of the first aspect, at least one composition of the second aspect, at least one polypeptide of the third aspect, at least one vaccine of the fourth aspect, or the kit or kit of parts of the fifth aspect;
b) applying or administering said nucleic acid, composition, polypeptide, vaccine, or kit or kit of parts to a subject as a first dose
c) optionally, applying or administering said nucleic acid, composition, polypeptide, vaccine, or kit or kit of parts to a subject as a second dose or a further dose, preferably at least 3, 4, 5, 6, 7, 8, 9, 10, 11, 12, months after the first dose.

The first dosage, as used herein, refers to the initial/first dose, a second dose or any further doses, respectively, which are administered to "boost" the immune reaction. In certain aspects, the vaccine/composition is administered to a subject one, two three, four or more times. In some aspects, the vaccine/composition is administered to the subject at least first and a second time (e.g., a prime and boost). I some aspects, the send administration is at least 10 days, 14 days, 21 days, 28 days, 35 days, 42 days, 49 days or 56 days after the first administration. In some aspects, the time between the first administration and the second administration is between about 7 days and about 56 days; about 14 days and about 56 days; about 21 days and about 56 days; or about 28 days and about 56 days. In further aspects, the vaccine/composition is administered to a subject three or more times. In certain aspects, there is at least 10 days, 14 days, 21 days, 28 days, 35 days, 42 days, 49 days or 56 days between each administration of the vaccine/composition.

In some aspects, a subject for treatment according to the embodiments was previously infected with SARS-CoV-2 or was previously treated with at least a first SARS-CoV-2 vaccine composition. In some aspects, the subject was treated with one, two, three or more doses of a first SARS-CoV-2 vaccine composition. In some aspects, the composition of the embodiments used to treat a subject is a different type of vaccine composition than the composition previously used to treat the subject. In some aspects, the subject was previously treated with a mRNA vaccine, such as BNT162, BNT162b2_B.1.1.529, BNT162b5, BNT162b2_BA.4/BA.5, mRNA-1273, mRNA-1273.211, mRNA-1273.214, mRNA-1273.222, and/or mRNA-1283. In further aspects, the subject was previously treated with a protein subunit vaccine, such as spike protein-based vaccine, e.g., NVX-CoV2373 or COVAX. In certain preferred aspects, protein subunit vaccine compositions comprise an adjuvant. In further aspects, the subject was previously treated with a viral vector vaccine, such as an adenovirus vector based vaccine, e.g., ADZ1222 or Ad26.COV-2.S. In still further aspects, the subject was previously treated with an inactivated virus vaccine to SARS-CoV-2 such as CoronaVac, BBIBP-CorV or BBV152. In further aspects, a subject previously treated with a vaccine composition has detectable SARS-CoV-2 binding antibodies, such as SARS-CoV-2 S protein-binding antibodies or SARS-CoV-2 N protein-binding antibodies. In further aspects, a subject for treatment according to the embodiments was treated with a first SARS-CoV-2 vaccine composition at least about 3 month, 6 months, 9 months, 1 year, 1.5 years, 2 years or 3 years ago. In still further aspects, a subject for treatment according to the embodiments was treated with a first SARS-CoV-2 vaccine composition between about 3 months and 2 years ago or between about 6 months and 2 years ago. In some aspects, a subjects treated with a further vaccine composition of the embodiments are protected from moderate and severe COVID-19 disease in at least 80%, 85%, 90% or 95% of treated subjects. For example, the treated subjects can be protected from moderate and severe COVID-19 disease in at least 80%, 85%, 90% or 95% of treated subjects from about 2 weeks to about 1 year after administration of the further composition. In still further aspects, administering the further vaccine composition of the embodiments prevents moderate and severe COVID-19 disease in at least 80%, 85%, 90% or 95% of treated subjects from about 2 weeks to about 3 month, 6 months, 9 months, 1 year, 1.5 years, 2 years or 3 years after said administration. Examples of such combination vaccination strategies are shown below:

Dose 1 mRNA vaccine-T1-dose 2 mRNA vaccine-T2-dose 3 mRNA vaccine
Dose 1 mRNA vaccine-T1-dose 2 mRNA vaccine-T2-dose 3 protein subunit vaccine
Dose 1 mRNA vaccine-T1-dose 2 mRNA vaccine-T2-dose 3 viral vector vaccine
Dose 1 mRNA vaccine-T1-dose 2 mRNA vaccine-T2-dose 3 inactivated virus vaccine
Dose 1 protein subunit vaccine-T1-dose 2 protein subunit vaccine-T2-dose 3 mRNA vaccine
Dose 1 inactivated virus vaccine-T1-dose 2 inactivated virus vaccine-T2-dose 3 mRNA vaccine
Dose 1 viral vector vaccine-T1-dose 2 viral vector vaccine-T2-dose 3 mRNA vaccine
Dose 1 viral vector vaccine-T2-dose 2 mRNA vaccine
Dose 1 protein subunit vaccine-T2-dose 2 mRNA vaccine
Dose 1 inactivated virus vaccine-T2-dose 2 mRNA vaccine
Dose 1 mRNA vaccine-T2-dose 2 mRNA vaccine In the examples, above time period 1 (T1) is typically 2 to 6 weeks, preferably 3 to 4 weeks. Time period 2 (T2) is in some cases, about 3 months, 6 months, 9 months, 1 year, 1.5 years, 2 years or three years.

In some aspects, a method of the embodiments comprises administering multiple doses of a vaccine composition to a subject. In a further aspect, there is provided a method of reducing reactogenicity of a SARS-CoV-2 booster vaccine composition. In some aspects, after an initial vaccination, subject exhibiting a high level of reactogenicity are administered a booster vaccine that is different from the initial vaccine composition. For example, in some aspects, the initial vaccine is BNT162, BNT162b2_B.1.1.529, BNT162b5, BNT162b2_BA.4/BA.5, mRNA-1273, mRNA-1273.211, mRNA-1273.214, mRNA-1273.222, and/or mRNA-1283. and the booster vaccine is a mRNA vaccine composition of the embodiments. In some aspects, a booster vaccine composition for a subject with high reactogenicity is selected based having a lower concentration of PEG or PEG-conjugate compared to the previously administered vaccine composition. In some aspects, a booster vaccine composition for a subject with high reactogenicity is selected based on a lower concentration of mRNA or LNP compared to the previously administered vaccine composition.

In certain aspects, a subject for treatment according to the embodiments is administered a vaccine composition as booster vaccine and has previously been treated with one or more administrations of a coronavirus vaccine composition. In certain aspects, the subject being treated with a booster vaccine previously was treated with a vaccine composition that included a spike protein antigen or a nucleic acid molecule encoding a spike protein antigen. In some aspects, the subject selected for treatment with the booster vaccine was previously administered a vaccine composition comprising, or encoding, a spike protein having a different amino acid sequence than the spike protein of the booster vaccine. In certain aspects, the previously administered vaccine composition comprised, or encoded, a spike (e.g., a SARS-CoV-2 spike) protein having at least 1, 2, 3, 4, 5, 6, 7, 8, 9, or 10 amino acid differences relative to the booster vaccine composition. In certain aspects, the booster vaccine composition comprises a RNA encoding a spike protein having about 1 to 50; about 3 to 30; about 5 to 30 or about 10 to 25 amino acid differences relative to the previously administered vaccine composition. In still further aspects, the booster vaccine composition comprises RNA encoding 2, 3, 4 or more distinct spike proteins with different amino acid sequences.

In further aspects, methods of the embodiments comprise administering 2 or more booster vaccine compositions to a subject, wherein each booster vaccine composition comprises RNA encoding a distinct spike protein with different amino acid sequences. In some aspects, such distinct booster vaccine compositions are administered essentially simultaneously or less than about 10 minutes, 20 minutes, 30 minutes, 1 hour or 2 hours apart. In some aspects, distinct booster vaccine compositions are administered to the same site, such as intramuscular injections to the same arm of the subject. In further aspects, distinct booster vaccine compositions are administered to different sites, such as intramuscular injections to different arms or to one or both arms and one more leg muscles.

In certain aspects, a method of the embodiments is further defined as a method of stimulating an antibody or CD8+ T-cell response in a subject. In some aspects, the method is defined as a method of stimulating a neutralizing antibody response in a subject. In further aspects, the method is defined as a method of stimulating a protective immune response in a subject. In yet further aspects, the method is defined as a method of stimulating TH2 directed immune response in a subject.

In further aspects, administration of a vaccine/composition/combination of the embodiments stimulates an antibody response that produces between about 10 and about 500 coronavirus spike protein-binding antibodies for every coronavirus neutralizing antibody in the subject. For example, the administration can stimulate an antibody response that produces no more than about 200 spike protein-binding antibodies for every coronavirus neutralizing antibody. In further aspects, the administration stimulates an antibody response that produces between about 10 and about 300; about 20 and about 300; about 20 and about 200; about 30 and about 100; or about 30 and about 80 coronavirus spike protein-binding antibodies for every coronavirus neutralizing antibody. In still further aspects, administration of composition of the embodiments stimulates an antibody response in a subject that includes a ratio of spike protein-binding antibodies to coronavirus neutralizing antibodies that is with 20%, 15%, 10% or 5% of the ratio of spike protein-binding antibodies to coronavirus neutralizing antibodies found in average convalescent patient serum (from a subject who has recovered from coronavirus infection).

In yet further aspects, administration of a vaccine/composition/combination of the embodiments stimulates an antibody response that produces between about 1 and about 500 coronavirus spike protein receptor binding domain (RBD)-binding antibodies for every coronavirus neutralizing antibody in the subject. In further aspects, the administration stimulates an antibody response that produces no more than about 50 spike protein RBD-binding antibodies for every coronavirus neutralizing antibody. In still further aspects, administration stimulates an antibody response that produces between about 1 and about 200; about 2 and about 100; about 3 and about 200; about 5 and about 100; about 5 and about 50; or about 5 and about 20 spike protein RBD-binding antibodies for every coronavirus neutralizing antibody. In still further aspects, administration of composition of the embodiments stimulates an antibody response in a subject that includes a ratio of spike protein RBD-binding antibodies to coronavirus neutralizing antibodies that is with 20%, 15%, 10% or 5% of the ratio of spike protein RBD-binding antibodies to coronavirus neutralizing antibodies found in average convalescent patient serum (from a subject who has recovered from coronavirus infection).

In still further aspects, administration of a vaccine/composition/combination of the embodiments induces essentially no increase in IL-4, IL-13, TNF and/or IL-1 in the subject. In further aspects, the administration of a vaccine/composition of the embodiments induces essentially no increase in serum IL-4, IL-13, TNF and/or IL-1 in the subject. In some aspects, the administration of a vaccine/composition of the embodiments induces essentially no increase in IL-4, IL-13, TNF and/or IL-1β at the injection site (e.g., an intramuscular injection site) in the subject.

In still further aspects, a method of the embodiments comprises administration of a vaccine/composition of the embodiments to a human subject having a disease. In certain aspects, the subject has cardiovascular disease, kidney disease, lung disease or an autoimmune disease. In some aspects, a vaccine/composition of the embodiments is administered to a subject who is receiving anti-coagulation therapy.

In still further aspects, administering a vaccine/composition/combination of the embodiments to human subjects results in no more than 20%, 15%, 10% 7.5% or 5% of the subjects experiencing a Grade 3 local adverse event (see Table 3a below). For example, in some aspects, no more than 10% of subjects experience a Grade 3 local adverse event after a first or a second dose of the composition. In preferred aspects, administering a composition of the embodiments to human subjects results in no more than 40%, 30%, 25%, 20%, 15%, 10%, 7.5% or 5% of the subjects experiencing a Grade 2 of higher local adverse event. For example, in some aspects, no more than 30% of subjects experience a Grade 2 or higher local adverse event after a first or a second dose of the composition. In some aspects, administering a composition of the embodiments to human subjects results in no more than 10% of the subjects experiencing Grade 3 pain, redness, swelling and/or itching at the injection site.

In further aspects, administering a vaccine/composition/combination of the embodiments to human subjects results in no more than 30%, 25%, 20%, 15%, 10% or 5% of the subjects experiencing a Grade 3 systemic adverse event. For example, in some aspects, no more than 25% of subjects experience a Grade 3 systemic adverse event after a first dose of the composition. In some aspects, no more than 40% of subjects experience a Grade 3 systemic adverse event after a second dose of the composition. In some aspects, administering a composition of the embodiments to human subjects results in no more than 30%, 25%, 20%, 15%, 10% or 5% of the subjects experiencing Grade 3 fever, headache, fatigue, chills, myalgia, arthralgia, nausea and/or diarrhea.

According to a further aspect, the present invention also provides a method for expression of at least one polypeptide comprising at least one peptide or protein derived from a coronavirus, or a fragment or variant thereof, wherein the method comprises the following steps:

a) providing at least one nucleic acid of the first aspect or at least one composition of the second aspect; and
b) applying or administering said nucleic acid or composition to an expression system (cells), a tissue, an organism. A suitable cell for expressing a polypeptide (that is encoded by the nucleic acid of the invention) may be a *Drosophila* S2 insect cell line.

The method for expression may be applied for laboratory, for research, for diagnostic, for commercial production of peptides or proteins and/or for therapeutic purposes. The method may furthermore be carried out in the context of the treatment of a specific disease, such as in the treatment of infectious diseases, such as coronavirus infections, preferably SARS-CoV-2 coronavirus infections and the disease COVID-19.

Likewise, according to another aspect, the present invention also provides the use of the nucleic acid, the composition, the polypeptide, the vaccine, or the kit or kit of parts for diagnostic or therapeutic purposes, e.g. for expression of an encoded coronavirus antigenic peptide or protein.

In specific embodiments, applying or administering said nucleic acid, polypeptide, composition, vaccine, combination to a tissue or an organism may be followed by e.g. a step of obtaining induced coronavirus antibodies e.g. SARS-CoV-2 coronavirus specific (monoclonal) antibodies or a step of obtaining generated SARS-CoV-2 coronavirus protein constructs (S protein).

The use may be applied for a (diagnostic) laboratory, for research, for diagnostics, for commercial production of peptides, proteins, or SARS-CoV-2 coronavirus antibodies and/or for therapeutic purposes. The use may be carried out in vitro, in vivo or ex vivo. The use may furthermore be carried out in the context of the treatment of a specific disease, such as in the treatment of a coronavirus infection (e.g. COVID-19) or a related disorder.

According to a further aspect, the present invention also provides a method of manufacturing a composition or a vaccine, comprising the steps of:
- a) RNA in vitro transcription step using a DNA template in the presence of a cap analogue to obtain capped mRNA, preferably having a nucleic acid sequence as provided in Table 2;
- b) Purifying the obtained capped RNA of step a) using RP-HPLC, and/or TFF, and/or Oligo(dT) purification and/or AEX, using RP-HPLC;
- c) Providing a first liquid composition comprising the purified capped RNA of step b);
- d) Providing a second liquid composition comprising at least one ionizable cationic lipid as defined herein, a neutral lipid as defined herein, a steroid or steroid analogue as defined herein, and a PEG-lipid as defined herein;
- e) Introducing the first liquid composition and the second liquid composition into at least one mixing means to allow the formation of LNPs comprising capped RNA;
- f) Purifying the obtained LNPs comprising capped RNA;
- g) optionally, lyophilizing the purified LNPs comprising capped RNA.

In embodiments, the mixing means of step e) is a T-piece connector or a microfluidic mixing device. In embodiments, the purifying step f) comprises at least one step selected from precipitation step, dialysis step, filtration step, TFF step. Optionally, an enzymatic polyadenylation step may be performed after step a) or b). Optionally, further purification steps may be implemented to e.g. remove residual DNA, buffers, small RNA by-products etc. Optionally, RNA in vitro transcription is performed in the absence of a cap analog, and an enzymatic capping step is performed after RNA vitro transcription. Optionally, RNA in vitro transcription is performed in the presence of at least one modified nucleotide as defined herein.

In embodiments, the RNA purification process involves at least one step of TFF, a proteinase K digestion step, a DNAse step, and an optional cellulose purification step.

In embodiments, the present invention also provides a method of manufacturing a composition or a vaccine, comprising the steps of:
- a) RNA in vitro transcription step using a DNA template in the absence of a cap analogue (and optionally modified nucleotides as defined herein) to obtain capped mRNA, preferably having a nucleic acid sequence as provided in Table 2;
- b) Purifying the RNA of step a) using Oligo(dT) purification;
- c) Optionally TFF;
- d) Enzymatic capping of the purified RNA;
- e) AEX;
- f) Optionally TFF;
- g) Providing a first liquid composition comprising the purified capped RNA of steps a-f);
- h) Providing a second liquid composition comprising at least one ionizable cationic lipid as defined herein, a neutral lipid as defined herein, a steroid or steroid analogue as defined herein, and a PEG-lipid as defined herein;
- i) Introducing the first liquid composition and the second liquid composition into at least one mixing means to allow the formation of LNPs comprising capped RNA;
- j) Purifying the obtained LNPs comprising capped RNA;
- k) optionally, lyophilizing the purified LNPs comprising capped RNA.

BRIEF DESCRIPTION OF LISTS

Figure 1:
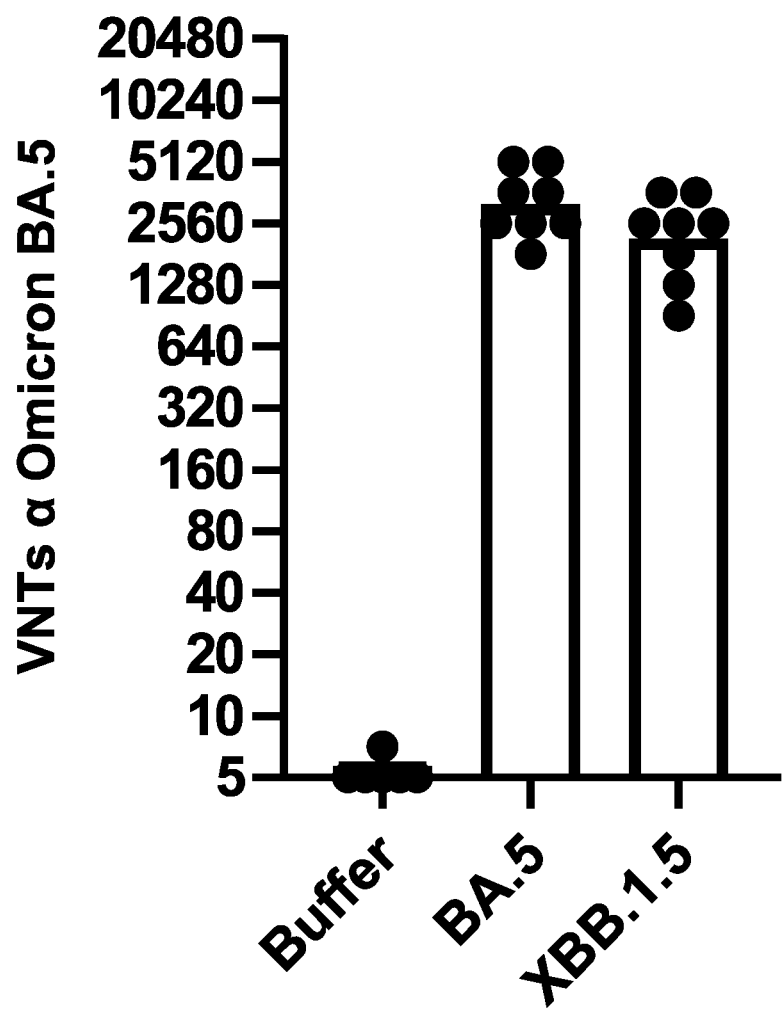
FIG. 1: Virus Neutralization Titers (VNT) against Omicron BA.5 were assessed at day 42 following i.m. immunization of Wistar rats with a dose of 2 µg of an immunogenic composition comprising a mRNA encoding either BA.5 or XBB.1.5 Spike protein; a control assay was performed with NaCl buffer.

List 1: Amino acid positions for substitutions deletions and/or insertions.
List 2: Amino acid substitutions deletions or insertions.
List 3: Further Amino acid positions for substitutions deletions and/or insertions.
List 4: Further Amino acid substitutions deletions or insertions.

BRIEF DESCRIPTION OF TABLES

Table 1: Preferred coronavirus constructs (amino acid sequences and nucleic acid coding sequences).
Table 2: RNA constructs suitable for a coronavirus vaccine.
Table 3: RNA constructs encoding different SARS-CoV-2 S antigen design (used in the Examples).
Table 4: Vaccination regimen (Example 3).
Table 5: Vaccination regimen (Example 6).
Table 6: Binding inhibition assay at d28 (0.25 µg-dose) (Example 6).
Table 7: Binding inhibition assay at d42 (0.25 µg-dose) (Example 6).
Table 8: Vaccination regimen (Example 7).
Table 9: Binding inhibition assay at d14 (2 µg dose) (Example 7).
Table 10: Binding inhibition assay at d28 (2 µg dose) (Example 7).
Table 11: Binding inhibition assay at d42 (2 µg dose) (Example 7).
Table 12: Vaccination regimen (Example 8).

EMBODIMENTS

Embodiment 1. RNA comprising at least one coding sequence encoding at least one SARS-CoV-2 spike protein or an immunogenic fragment or immunogenic variant thereof, wherein the SARS-CoV-2 spike protein comprises at least one amino acid substitution, deletion or insertion, wherein the at least one amino acid substitution, deletion or insertion is located at a position selected from the group consisting of: N460, K444, T604, D574, K182, Y200, L518, E554, T572, Q675, D1153, E180, R21, V83, K97, H146, K147, N164, Q183, G184, N185, F186, P209, S256, G257, K356, L368, I410, P521, N658, I666, G798, T883, S1003, A1020, E1144, D1199 and C1243, relative to the sequence of SEQ ID NO: 1.

Embodiment 2. The RNA of Embodiment 1, wherein the SARS-CoV-2 spike protein comprises at least one amino acid substitution, deletion or insertion at the position corresponding to N460, relative to the sequence of SEQ ID NO: 1.

Embodiment 3. The RNA of Embodiment 1, wherein the SARS-CoV-2 spike protein comprises at least one amino acid substitution, deletion or insertion at the position corresponding to K444, relative to the sequence of SEQ ID NO: 1.

Embodiment 4. The RNA of Embodiment 1, wherein the SARS-CoV-2 spike protein comprises at least one amino acid substitution, deletion or insertion at the position corresponding to T604, relative to the sequence of SEQ ID NO: 1.

Embodiment 5. The RNA of Embodiment 1, wherein the SARS-CoV-2 spike protein comprises at least one amino acid substitution, deletion or insertion at the position corresponding to D574, relative to the sequence of SEQ ID NO: 1.

Embodiment 6. The RNA of Embodiment 1, wherein the SARS-CoV-2 spike protein comprises at least one amino acid substitution, deletion or insertion at the position corresponding to D574, relative to the sequence of SEQ ID NO: 1.

Embodiment 7. The RNA of Embodiment 1, wherein the SARS-CoV-2 spike protein comprises at least one amino acid substitution, deletion or insertion at the position corresponding to Y200, relative to the sequence of SEQ ID NO: 1.

Embodiment 8. The RNA of Embodiment 1, wherein the SARS-CoV-2 spike protein comprises at least one amino acid substitution, deletion or insertion at the position corresponding to L518, relative to the sequence of SEQ ID NO: 1.

Embodiment 9. The RNA of Embodiment 1, wherein the SARS-CoV-2 spike protein comprises at least one amino acid substitution, deletion or insertion at the position corresponding to E554, relative to the sequence of SEQ ID NO: 1.

Embodiment 10. The RNA of Embodiment 1, wherein the SARS-CoV-2 spike protein comprises at least one amino acid substitution, deletion or insertion at the position corresponding to T572, relative to the sequence of SEQ ID NO: 1.

Embodiment 11. The RNA of Embodiment 1, wherein the SARS-CoV-2 spike protein comprises at least one amino acid substitution, deletion or insertion at the position corresponding to Q675, relative to the sequence of SEQ ID NO: 1.

Embodiment 12. The RNA of Embodiment 1, wherein the SARS-CoV-2 spike protein comprises at least one amino acid substitution, deletion or insertion at the position corresponding to D1153, relative to the sequence of SEQ ID NO: 1.

Embodiment 13. The RNA of Embodiment 1, wherein the SARS-CoV-2 spike protein comprises at least one amino acid substitution, deletion or insertion at the position corresponding to E180, relative to the sequence of SEQ ID NO: 1.

Embodiment 14. The RNA of Embodiment 1, wherein the SARS-CoV-2 spike protein comprises at least one amino acid substitution, deletion or insertion at the position corresponding to R21, relative to the sequence of SEQ ID NO: 1.

Embodiment 15. The RNA of Embodiment 1, wherein the SARS-CoV-2 spike protein comprises at least one amino acid substitution, deletion or insertion at the position corresponding to V83, relative to the sequence of SEQ ID NO: 1.

Embodiment 16. The RNA of Embodiment 1, wherein the SARS-CoV-2 spike protein comprises at least one amino acid substitution, deletion or insertion at the position corresponding to K97, relative to the sequence of SEQ ID NO: 1.

Embodiment 17. The RNA of Embodiment 1, wherein the SARS-CoV-2 spike protein comprises at least one amino acid substitution, deletion or insertion at the position corresponding to H146, relative to the sequence of SEQ ID NO: 1.

Embodiment 18. The RNA of Embodiment 1, wherein the SARS-CoV-2 spike protein comprises at least one amino acid substitution, deletion or insertion at the position corresponding to K147, relative to the sequence of SEQ ID NO: 1.

Embodiment 19. The RNA of Embodiment 1, wherein the SARS-CoV-2 spike protein comprises at least one amino acid substitution, deletion or insertion at the position corresponding to N164, relative to the sequence of SEQ ID NO: 1.

Embodiment 20. The RNA of Embodiment 1, wherein the SARS-CoV-2 spike protein comprises at least one amino acid substitution, deletion or insertion at the position corresponding to Q183, relative to the sequence of SEQ ID NO: 1.

Embodiment 21. The RNA of Embodiment 1, wherein the SARS-CoV-2 spike protein comprises at least one amino acid substitution, deletion or insertion at the position corresponding to G184, relative to the sequence of SEQ ID NO: 1.

Embodiment 22. The RNA of Embodiment 1, wherein the SARS-CoV-2 spike protein comprises at least one amino acid substitution, deletion or insertion at the position corresponding to N185, relative to the sequence of SEQ ID NO: 1.

Embodiment 23. The RNA of Embodiment 1, wherein the SARS-CoV-2 spike protein comprises at least one amino acid substitution, deletion or insertion at the position corresponding to F186, relative to the sequence of SEQ ID NO: 1.

Embodiment 24. The RNA of Embodiment 1, wherein the SARS-CoV-2 spike protein comprises at least one amino acid substitution, deletion or insertion at the position corresponding to P209, relative to the sequence of SEQ ID NO: 1.

Embodiment 25. The RNA of Embodiment 1, wherein the SARS-CoV-2 spike protein comprises at least one amino acid substitution, deletion or insertion at the position corresponding to S256, relative to the sequence of SEQ ID NO: 1.

Embodiment 26. The RNA of Embodiment 1, wherein the SARS-CoV-2 spike protein comprises at least one amino acid substitution, deletion or insertion at the position corresponding to G257, relative to the sequence of SEQ ID NO: 1.

Embodiment 27. The RNA of Embodiment 1, wherein the SARS-CoV-2 spike protein comprises at least one amino acid substitution, deletion or insertion at the position corresponding to K356, relative to the sequence of SEQ ID NO: 1.

Embodiment 28. The RNA of Embodiment 1, wherein the SARS-CoV-2 spike protein comprises at least one amino acid substitution, deletion or insertion at the position corresponding to L368, relative to the sequence of SEQ ID NO: 1.

Embodiment 29. The RNA of Embodiment 1, wherein the SARS-CoV-2 spike protein comprises at least one amino acid substitution, deletion or insertion at the position corresponding to I410, relative to the sequence of SEQ ID NO: 1.

Embodiment 30. The RNA of Embodiment 1, wherein the SARS-CoV-2 spike protein comprises at least one amino acid substitution, deletion or insertion at the position corresponding to P521, relative to the sequence of SEQ ID NO: 1.

Embodiment 31. The RNA of Embodiment 1, wherein the SARS-CoV-2 spike protein comprises at least one amino acid substitution, deletion or insertion at the position corresponding to N658, relative to the sequence of SEQ ID NO: 1.

Embodiment 32. The RNA of Embodiment 1, wherein the SARS-CoV-2 spike protein comprises at least one amino acid substitution, deletion or insertion at the position corresponding to I666, relative to the sequence of SEQ ID NO: 1.

Embodiment 33. The RNA of Embodiment 1, wherein the SARS-CoV-2 spike protein comprises at least one amino acid substitution, deletion or insertion at the position corresponding to G798, relative to the sequence of SEQ ID NO: 1.

Embodiment 34. The RNA of Embodiment 1, wherein the SARS-CoV-2 spike protein comprises at least one amino acid substitution, deletion or insertion at the position corresponding to T883, relative to the sequence of SEQ ID NO: 1.

Embodiment 35. The RNA of Embodiment 1, wherein the SARS-CoV-2 spike protein comprises at least one amino acid substitution, deletion or insertion at the position corresponding to S1003, relative to the sequence of SEQ ID NO: 1.

Embodiment 36. The RNA of Embodiment 1, wherein the SARS-CoV-2 spike protein comprises at least one amino acid substitution, deletion or insertion at the position corresponding to A1020, relative to the sequence of SEQ ID NO: 1.

Embodiment 37. The RNA of Embodiment 1, wherein the SARS-CoV-2 spike protein comprises at least one amino acid substitution, deletion or insertion at the position corresponding to E1144, relative to the sequence of SEQ ID NO: 1.

Embodiment 38. The RNA of Embodiment 1, wherein the SARS-CoV-2 spike protein comprises at least one amino acid substitution, deletion or insertion at the position corresponding to D1199, relative to the sequence of SEQ ID NO: 1.

Embodiment 39. The RNA of Embodiment 1, wherein the SARS-CoV-2 spike protein comprises at least one amino acid substitution, deletion or insertion at the position corresponding to C1243, relative to the sequence of SEQ ID NO: 1.

Embodiment 40. The RNA of Embodiment 1, wherein the SARS-CoV-2 spike protein comprises at least 2, 3, 4, 5, 6, 7, 8, 9, 10, 11, 12, 13, 14, or 15 amino acid substitutions, deletions or insertions at the position corresponding to: N460, K444, T604, D574, K182, Y200, L518, E554, T572, Q675, D1153, E180, R21, V83, K97, H146, K147, N164, Q183, G184, N185, F186, P209, S256, G257, K356, L368, I410, P521, N658, I666, G798, T883, S1003, A1020, E1144, D1199 and C1243, relative to the sequence of SEQ ID NO: 1.

Embodiment 41. The RNA of Embodiment 1 or 40, wherein the SARS-CoV-2 spike protein comprises at least two amino acid substitution, deletion or insertion at the position corresponding to: N460 and K444, relative to the sequence of SEQ ID NO: 1.

Embodiment 42. The RNA of Embodiment 1 or 40, wherein the SARS-CoV-2 spike protein comprises at least 6 amino acid substitutions, deletions or insertions at the position corresponding to: N460, V83, H146, Q183, G257, L368, relative to the sequence of SEQ ID NO: 1.

Embodiment 43. RNA comprising at least one coding sequence encoding at least one SARS-CoV-2 spike protein or an immunogenic fragment or immunogenic variant thereof, wherein the SARS-CoV-2 spike protein comprises at least one amino acid substitution selected from the group consisting of: N460K, K444M, K444R, K444T, V445P, E484R, F486P, K356T, D574V, T604I, Q52H, K147N, K182N, Y200C, T478Q, L518V, E554K, Q675H, T572I, D1153Y, E180V, P25S, V83A, H146Q, K147E, Q183E, I210V, L212S, V213E, D215H, H245N, G252V, G257D, G257S, G339H, L368I, N450D, F486S, F490V, N658S, G798D, S1003I, A1020S, D1199N, K97R, N164K, P209L, S256L, I666V, R21G, H146K, G184V, N185D, F186L, P521S, T883I, E1144Q, C1243F, D80Y, T547I and I410V relative to the sequence of SEQ ID NO: 1.

Embodiment 44. The RNA of Embodiment 43, wherein the SARS-CoV-2 spike protein comprises at least the amino acid substitution N460K, relative to the sequence of SEQ ID NO: 1.

Embodiment 45. The RNA of Embodiment 43, wherein the SARS-CoV-2 spike protein comprises at least the amino acid substitution K444M, relative to the sequence of SEQ ID NO: 1.

Embodiment 46. The RNA of Embodiment 43, wherein the SARS-CoV-2 spike protein comprises at least the amino acid substitution K444R, relative to the sequence of SEQ ID NO: 1.

Embodiment 47. The RNA of Embodiment 43, wherein the SARS-CoV-2 spike protein comprises at least the amino acid substitution K444T, relative to the sequence of SEQ ID NO: 1.

Embodiment 48. The RNA of Embodiment 43, wherein the SARS-CoV-2 spike protein comprises at least the amino acid substitution V445P, relative to the sequence of SEQ ID NO: 1.

Embodiment 49. The RNA of Embodiment 43, wherein the SARS-CoV-2 spike protein comprises at least the amino acid substitution E484R, relative to the sequence of SEQ ID NO: 1.

Embodiment 50. The RNA of Embodiment 43, wherein the SARS-CoV-2 spike protein comprises at least the amino acid substitution F486P, relative to the sequence of SEQ ID NO: 1.

Embodiment 51. The RNA of Embodiment 43, wherein the SARS-CoV-2 spike protein comprises at least the amino acid substitution K356T, relative to the sequence of SEQ ID NO: 1.

Embodiment 52. The RNA of Embodiment 43, wherein the SARS-CoV-2 spike protein comprises at least the amino acid substitution D574V, relative to the sequence of SEQ ID NO: 1.

Embodiment 53. The RNA of Embodiment 43, wherein the SARS-CoV-2 spike protein comprises at least the amino acid substitution T604I, relative to the sequence of SEQ ID NO: 1.

Embodiment 54. The RNA of Embodiment 43, wherein the SARS-CoV-2 spike protein comprises at least the amino acid substitution Q52H, relative to the sequence of SEQ ID NO: 1.

Embodiment 55. The RNA of Embodiment 43, wherein the SARS-CoV-2 spike protein comprises at least the amino acid substitution K147N, relative to the sequence of SEQ ID NO: 1.

Embodiment 56. The RNA of Embodiment 43, wherein the SARS-CoV-2 spike protein comprises at least the amino acid substitution K182N, relative to the sequence of SEQ ID NO: 1.

Embodiment 57. The RNA of Embodiment 43, wherein the SARS-CoV-2 spike protein comprises at least the amino acid substitution Y200C, relative to the sequence of SEQ ID NO: 1.

Embodiment 58. The RNA of Embodiment 43, wherein the SARS-CoV-2 spike protein comprises at least the amino acid substitution T478Q, relative to the sequence of SEQ ID NO: 1.

Embodiment 59. The RNA of Embodiment 43, wherein the SARS-CoV-2 spike protein comprises at least the amino acid substitution L518V, relative to the sequence of SEQ ID NO: 1.

Embodiment 60. The RNA of Embodiment 43, wherein the SARS-CoV-2 spike protein comprises at least the amino acid substitution E554K, relative to the sequence of SEQ ID NO: 1.

Embodiment 61. The RNA of Embodiment 43, wherein the SARS-CoV-2 spike protein comprises at least the amino acid substitution Q675H, relative to the sequence of SEQ ID NO: 1.

Embodiment 62. The RNA of Embodiment 43, wherein the SARS-CoV-2 spike protein comprises at least the amino acid substitution T572I, relative to the sequence of SEQ ID NO: 1.

Embodiment 63. The RNA of Embodiment 43, wherein the SARS-CoV-2 spike protein comprises at least the amino acid substitution D1153Y, relative to the sequence of SEQ ID NO: 1.

Embodiment 64. The RNA of Embodiment 43, wherein the SARS-CoV-2 spike protein comprises at least the amino acid substitution E180V, relative to the sequence of SEQ ID NO: 1.

Embodiment 65. The RNA of Embodiment 43, wherein the SARS-CoV-2 spike protein comprises at least the amino acid substitution P25S, relative to the sequence of SEQ ID NO: 1.

Embodiment 66. The RNA of Embodiment 43, wherein the SARS-CoV-2 spike protein comprises at least the amino acid substitution V83A, relative to the sequence of SEQ ID NO: 1.

Embodiment 67. The RNA of Embodiment 43, wherein the SARS-CoV-2 spike protein comprises at least the amino acid substitution H146Q, relative to the sequence of SEQ ID NO: 1.

Embodiment 68. The RNA of Embodiment 43, wherein the SARS-CoV-2 spike protein comprises at least the amino acid substitution K147E, relative to the sequence of SEQ ID NO: 1.

Embodiment 69. The RNA of Embodiment 43, wherein the SARS-CoV-2 spike protein comprises at least the amino acid substitution Q183E, relative to the sequence of SEQ ID NO: 1.

Embodiment 70. The RNA of Embodiment 43, wherein the SARS-CoV-2 spike protein comprises at least the amino acid substitution I210V, relative to the sequence of SEQ ID NO: 1.

Embodiment 71. The RNA of Embodiment 43, wherein the SARS-CoV-2 spike protein comprises at least the amino acid substitution L212S, relative to the sequence of SEQ ID NO: 1.

Embodiment 72. The RNA of Embodiment 43, wherein the SARS-CoV-2 spike protein comprises at least the amino acid substitution V213E, relative to the sequence of SEQ ID NO: 1.

Embodiment 73. The RNA of Embodiment 43, wherein the SARS-CoV-2 spike protein comprises at least the amino acid substitution D215H, relative to the sequence of SEQ ID NO: 1.

Embodiment 74. The RNA of Embodiment 43, wherein the SARS-CoV-2 spike protein comprises at least the amino acid substitution H245N, relative to the sequence of SEQ ID NO: 1.

Embodiment 75. The RNA of Embodiment 43, wherein the SARS-CoV-2 spike protein comprises at least the amino acid substitution G252V, relative to the sequence of SEQ ID NO: 1.

Embodiment 76. The RNA of Embodiment 43, wherein the SARS-CoV-2 spike protein comprises at least the amino acid substitution G257D, relative to the sequence of SEQ ID NO: 1.

Embodiment 77. The RNA of Embodiment 43, wherein the SARS-CoV-2 spike protein comprises at least the amino acid substitution G257S, relative to the sequence of SEQ ID NO: 1.

Embodiment 78. The RNA of Embodiment 43, wherein the SARS-CoV-2 spike protein comprises at least the amino acid substitution G339H, relative to the sequence of SEQ ID NO: 1.

Embodiment 79. The RNA of Embodiment 43, wherein the SARS-CoV-2 spike protein comprises at least the amino acid substitution L368I, relative to the sequence of SEQ ID NO: 1.

Embodiment 80. The RNA of Embodiment 43, wherein the SARS-CoV-2 spike protein comprises at least the amino acid substitution N450D, relative to the sequence of SEQ ID NO: 1.

Embodiment 81. The RNA of Embodiment 43, wherein the SARS-CoV-2 spike protein comprises at least the amino acid substitution F486S, relative to the sequence of SEQ ID NO: 1.

Embodiment 82. The RNA of Embodiment 43, wherein the SARS-CoV-2 spike protein comprises at least the amino acid substitution F490V, relative to the sequence of SEQ ID NO: 1.

Embodiment 83. The RNA of Embodiment 43, wherein the SARS-CoV-2 spike protein comprises at least the amino acid substitution N658S, relative to the sequence of SEQ ID NO: 1.

Embodiment 84. The RNA of Embodiment 43, wherein the SARS-CoV-2 spike protein comprises at least the amino acid substitution G798D, relative to the sequence of SEQ ID NO: 1.

Embodiment 85. The RNA of Embodiment 43, wherein the SARS-CoV-2 spike protein comprises at least the amino acid substitution S1003I, relative to the sequence of SEQ ID NO: 1.

Embodiment 86. The RNA of Embodiment 43, wherein the SARS-CoV-2 spike protein comprises at least the amino acid substitution A1020S, relative to the sequence of SEQ ID NO: 1.

Embodiment 87. The RNA of Embodiment 43, wherein the SARS-CoV-2 spike protein comprises at least the amino acid substitution D1199N, relative to the sequence of SEQ ID NO: 1.

Embodiment 88. The RNA of Embodiment 43, wherein the SARS-CoV-2 spike protein comprises at least the amino acid substitution K97R, relative to the sequence of SEQ ID NO: 1.

Embodiment 89. The RNA of Embodiment 43, wherein the SARS-CoV-2 spike protein comprises at least the amino acid substitution N164K, relative to the sequence of SEQ ID NO: 1.

Embodiment 90. The RNA of Embodiment 43, wherein the SARS-CoV-2 spike protein comprises at least the amino acid substitution P209L, relative to the sequence of SEQ ID NO: 1.

Embodiment 91. The RNA of Embodiment 43, wherein the SARS-CoV-2 spike protein comprises at least the amino acid substitution S256L, relative to the sequence of SEQ ID NO: 1.

Embodiment 92. The RNA of Embodiment 43, wherein the SARS-CoV-2 spike protein comprises at least the amino acid substitution I666V, relative to the sequence of SEQ ID NO: 1.

Embodiment 93. The RNA of Embodiment 43, wherein the SARS-CoV-2 spike protein comprises at least the amino acid substitution R21G, relative to the sequence of SEQ ID NO: 1.

Embodiment 94. The RNA of Embodiment 43, wherein the SARS-CoV-2 spike protein comprises at least the amino acid substitution H146K, relative to the sequence of SEQ ID NO: 1.

Embodiment 95. The RNA of Embodiment 43, wherein the SARS-CoV-2 spike protein comprises at least the amino acid substitution G184V, relative to the sequence of SEQ ID NO: 1.

Embodiment 96. The RNA of Embodiment 43, wherein the SARS-CoV-2 spike protein comprises at least the amino acid substitution N185D, relative to the sequence of SEQ ID NO: 1.

Embodiment 97. The RNA of Embodiment 43, wherein the SARS-CoV-2 spike protein comprises at least the amino acid substitution F186L, relative to the sequence of SEQ ID NO: 1.

Embodiment 98. The RNA of Embodiment 43, wherein the SARS-CoV-2 spike protein comprises at least the amino acid substitution P521S, relative to the sequence of SEQ ID NO: 1.

Embodiment 99. The RNA of Embodiment 43, wherein the SARS-CoV-2 spike protein comprises at least the amino acid substitution T883I, relative to the sequence of SEQ ID NO: 1.

Embodiment 100. The RNA of Embodiment 43, wherein the SARS-CoV-2 spike protein comprises at least the amino acid substitution E1144Q, relative to the sequence of SEQ ID NO: 1.

Embodiment 101. The RNA of Embodiment 43, wherein the SARS-CoV-2 spike protein comprises at least the amino acid substitution C1243F, relative to the sequence of SEQ ID NO: 1.

Embodiment 102. The RNA of Embodiment 43, wherein the SARS-CoV-2 spike protein comprises at least the amino acid substitution D80Y, relative to the sequence of SEQ ID NO: 1.

Embodiment 103. The RNA of Embodiment 43, wherein the SARS-CoV-2 spike protein comprises at least the amino acid substitution D215H, relative to the sequence of SEQ ID NO: 1.

Embodiment 104. The RNA of Embodiment 43, wherein the SARS-CoV-2 spike protein comprises at least the amino acid substitution T547I, relative to the sequence of SEQ ID NO: 1.

Embodiment 105. The RNA of Embodiment 43, wherein the SARS-CoV-2 spike protein comprises at least the amino acid substitution I410V, relative to the sequence of SEQ ID NO: 1.

Embodiment 106. The RNA of Embodiment 43, wherein the SARS-CoV-2 spike protein comprises at least 2, 3, 4, 5, 6, 7, 8, 9, 10, 11, 12, 13, 14, 15, 16, 17, 18, 19, 20, 21, 22, or 23 amino acid substitutions corresponding to: N460K, K444M, K444R, K444T, V445P, E484R, F486P, K356T, D574V, T604I, Q52H, K147N, K182N, Y200C, T478Q, L518V, E554K, Q675H, T572I, D1153Y, E180V, P25S, V83A, H146Q, K147E, Q183E, I210V, L212S, V213E, D215H, H245N, G252V, G257D, G257S, G339H, L368I, N450D, F486S, F490V, N658S, G798D, S1003I, A1020S, D1199N, K97R, N164K, P209L, S256L, I666V, R21G, H146K, G184V, N185D, F186L, P521S, T883I, E1144Q, C1243F, D80Y, T547I and I410V, relative to the sequence of SEQ ID NO: 1.

Embodiment 107. The RNA of Embodiment 43 or 106, wherein the SARS-CoV-2 spike protein comprises at least two amino acid substitutions corresponding to: N460K and K444T, relative to the sequence of SEQ ID NO: 1.

Embodiment 108. The RNA of Embodiment 43 or 106, wherein the SARS-CoV-2 spike protein comprises at least two amino acid substitutions corresponding to: N460K and K444M, relative to the sequence of SEQ ID NO: 1.

Embodiment 109. The RNA of Embodiment 43 or 106, wherein the SARS-CoV-2 spike protein comprises at least two amino acid substitutions corresponding to: N460K and F486P, relative to the sequence of SEQ ID NO: 1.

Embodiment 110. The RNA of Embodiment 43 or 106, wherein the SARS-CoV-2 spike protein comprises at least two amino acid substitutions corresponding to: N460K and E180V, relative to the sequence of SEQ ID NO: 1.

Embodiment 111. The RNA of Embodiment 43 or 106, wherein the SARS-CoV-2 spike protein comprises at least two amino acid substitutions corresponding to: N460K and D215H, relative to the sequence of SEQ ID NO: 1.

Embodiment 112. The RNA of Embodiment 43 or 106, wherein the SARS-CoV-2 spike protein comprises at least two amino acid substitutions corresponding to: N460K and P521S, relative to the sequence of SEQ ID NO: 1.

Embodiment 113. The RNA of Embodiment 43 or 106, wherein the SARS-CoV-2 spike protein comprises at least two amino acid substitutions corresponding to: N460K and D80Y, relative to the sequence of SEQ ID NO: 1.

Embodiment 114. The RNA of Embodiment 43 or 106, wherein the SARS-CoV-2 spike protein comprises at least two amino acid substitutions corresponding to: N460K and G184V, relative to the sequence of SEQ ID NO: 1.

Embodiment 115. The RNA of Embodiment 43 or 106, wherein the SARS-CoV-2 spike protein comprises at least two amino acid substitutions corresponding to: N460K and N185D, relative to the sequence of SEQ ID NO: 1.

Embodiment 116. The RNA of Embodiment 43 or 106, wherein the SARS-CoV-2 spike protein comprises at least two amino acid substitutions corresponding to: N460K and T883I, relative to the sequence of SEQ ID NO: 1.

Embodiment 117. The RNA of Embodiment 43 or 106, wherein the SARS-CoV-2 spike protein comprises at least two amino acid substitutions corresponding to: N460K and E1144Q, relative to the sequence of SEQ ID NO: 1.

Embodiment 118. The RNA of Embodiment 43 or 106, wherein the SARS-CoV-2 spike protein comprises at least two amino acid substitutions corresponding to: N460K and Q613H, relative to the sequence of SEQ ID NO: 1.

Embodiment 119. The RNA of Embodiment 43 or 106, wherein the SARS-CoV-2 spike protein comprises at least two amino acid substitutions corresponding to: F486P and D614G, relative to the sequence of SEQ ID NO: 1.

Embodiment 120. The RNA of Embodiment 43 or 106, wherein the SARS-CoV-2 spike protein comprises at least two amino acid substitutions corresponding to: R21G and F186L, relative to the sequence of SEQ ID NO: 1.

Embodiment 121. The RNA of Embodiment 43 or 106, wherein the SARS-CoV-2 spike protein comprises at least two amino acid substitutions corresponding to: I410V and P521S, relative to the sequence of SEQ ID NO: 1.

Embodiment 122. The RNA of Embodiment 43 or 106, wherein the SARS-CoV-2 spike protein comprises at least 10 amino acid substitutions corresponding to: N460K, V445P, V83A, H146Q, Q183E, V213E, G252V, G339H, L368I, and F486S, relative to the sequence of SEQ ID NO: 1.

Embodiment 123. The RNA of Embodiment 43 or 106, wherein the SARS-CoV-2 spike protein comprises at least 10 amino acid substitutions corresponding to: N460K, F486P, V445P, V83A, H146Q, Q183E, V213E, G252V, G339H, and L368I, relative to the sequence of SEQ ID NO: 1.

Embodiment 124. The RNA of Embodiment 43 or 106, wherein the SARS-CoV-2 spike protein comprises at least 10 amino acid substitutions corresponding to: D614G, N460K, F486P, V445P, V83A, H146Q, Q183E, V213E, G252V, G339H, and L368I, relative to the sequence of SEQ ID NO: 1.

Embodiment 125. The RNA of Embodiment 43 or 106, wherein the SARS-CoV-2 spike protein comprises at least 10 amino acid substitutions corresponding to: N460K, E180V, T478R and F486P, relative to the sequence of SEQ ID NO: 1.

Embodiment 126. The RNA of Embodiment 43 or 106, wherein the SARS-CoV-2 spike protein comprises at least 10 amino acid substitutions corresponding to: N460K, K444T and L452R, relative to the sequence of SEQ ID NO: 1.

Embodiment 127. The RNA of Embodiment 43 or 106, wherein the SARS-CoV-2 spike protein comprises at least 10 amino acid substitutions corresponding to: N460K, D215G and Q613H, relative to the sequence of SEQ ID NO: 1.

Embodiment 128. The RNA of any one of the preceding Embodiments, wherein the SARS-CoV-2 spike protein comprises at least one further amino acid substitution, deletion or insertion, wherein the at least one amino acid substitution, deletion or insertion is located at a position selected from the group consisting of:

L5, L8, P9, S12, S13, L18, T19, T20, L24, P25, P26, A27, H49, Q52, A67, H69, V70, G75, T76, D80, T95, V126, C136, D138, L141, G142, V143, Y144, Y145, ins145, W152, M153, E154, E156, F157, R158, R190, I210, N211, L212, V213, R214, ins214, D215, A222, Q239, E241, L242, A243, L244, H245, R246, S247, Y248, L249, T250, P251, G252, D253, S254, W258, Q321, G339, V341, R346, A348, N354, R357, S359, V367, S371, S373, S375, T376, K378, P384, R403, D405, R408, Q409, Q414, K417, A435, N437, N439, N440, V445, G446, G447, Y449, N450, L452, Y453, L455, F456, K458, I472, A475, G476, S477, T478, V483, E484, G485, F486, N487, F490, Q493, S494, G496, Q498, P499, T500, N501, G502, V503, G504, Y505, Q506, Y508, H519, A522, T547, K558, A570, Q613, D614, H655, G669, Q677, N679, P681, R682, R683, A684, R685, I692, A701, T716, T732, T748, N764, G769, D796, A831, A845, N856, T859, F888, A899, D936, S939, S940, S943, Q949, D950, Q954, Q957, N969, L981, S982, T1027, V1040, Q1071, E1092, H1101, D1118, S1147, V1176, N1187, M1229, C1254, and P1263, relative to the sequence of SEQ ID NO: 1.

Embodiment 129. The RNA of Embodiment 128, wherein the SARS-CoV-2 spike protein comprises at least the amino acid substitutions, deletions or insertions at the positions corresponding to: N460 and F490, relative to the sequence of SEQ ID NO: 1.

Embodiment 130. The RNA of Embodiment 128, wherein the SARS-CoV-2 spike protein comprises at least the amino acid substitutions, deletions or insertions at the positions corresponding to: N460, R346, and F490, relative to the sequence of SEQ ID NO: 1.

Embodiment 131. The RNA of Embodiment 128, wherein the SARS-CoV-2 spike protein comprises at least the amino acid substitutions, deletions or insertions at the positions corresponding to: N460, R346, F490 and Y144, relative to the sequence of SEQ ID NO: 1.

Embodiment 132. The RNA of Embodiment 128, wherein the SARS-CoV-2 spike protein comprises at least the amino acid substitutions, deletions or insertions at the positions corresponding to: N460 and D614, relative to the sequence of SEQ ID NO: 1.

Embodiment 133. The RNA of Embodiment 128, wherein the SARS-CoV-2 spike protein comprises at least the amino acid substitutions, deletions or insertions at the positions corresponding to: N460, D614, and L452, relative to the sequence of SEQ ID NO: 1.

Embodiment 134. The RNA of Embodiment 128, wherein the SARS-CoV-2 spike protein comprises at least the amino acid substitutions, deletions or insertions at the positions corresponding to: N460, K444, and R346, relative to the sequence of SEQ ID NO: 1.

Embodiment 135. The RNA of Embodiment 128, wherein the SARS-CoV-2 spike protein comprises at least the amino acid substitutions, deletions or insertions at the positions corresponding to: N460, K444, and Y144, relative to the sequence of SEQ ID NO: 1.

Embodiment 136. The RNA of Embodiment 128, wherein the SARS-CoV-2 spike protein comprises at least the amino acid substitutions, deletions or insertions at the positions corresponding to: T604 and L452, relative to the sequence of SEQ ID NO: 1.

Embodiment 137. The RNA of Embodiment 128, wherein the SARS-CoV-2 spike protein comprises at least the amino acid substitutions, deletions or insertions at the positions corresponding to: K444, A1020, and D614, relative to the sequence of SEQ ID NO: 1.

Embodiment 138. The RNA of Embodiment 128, wherein the SARS-CoV-2 spike protein comprises at least the amino acid substitutions, deletions or insertions at the positions corresponding to: N460, F486 and F490, relative to the sequence of SEQ ID NO: 1.

Embodiment 139. The RNA of Embodiment 128, wherein the SARS-CoV-2 spike protein comprises at least the amino acid substitutions, deletions or insertions at the positions corresponding to: N460, F486, R346 and F490, relative to the sequence of SEQ ID NO: 1.

Embodiment 140. The RNA of Embodiment 128, wherein the SARS-CoV-2 spike protein comprises at least the amino acid substitutions, deletions or insertions at the positions corresponding to: N460, F486, R346, F490 and Y144, relative to the sequence of SEQ ID NO: 1.

Embodiment 141. The RNA of Embodiment 128, wherein the SARS-CoV-2 spike protein comprises at least the amino acid substitutions, deletions or insertions at the positions corresponding to: N460, F486, and D614, relative to the sequence of SEQ ID NO: 1.

Embodiment 142. The RNA of Embodiment 128, wherein the SARS-CoV-2 spike protein comprises at least the amino acid substitutions, deletions or insertions at the positions corresponding to: N460, F486, R346, F490, Y144, and D614, relative to the sequence of SEQ ID NO: 1.

Embodiment 143. The RNA of Embodiment 128, wherein the SARS-CoV-2 spike protein comprises at least the amino acid substitutions, deletions or insertions at the positions corresponding to: N460 and F490, relative to the sequence of SEQ ID NO: 1.

Embodiment 144. The RNA of Embodiment 128, wherein the SARS-CoV-2 spike protein comprises at least the amino acid substitutions, deletions or insertions at the positions corresponding to: K444 and L452, relative to the sequence of SEQ ID NO: 1.

Embodiment 145. The RNA of Embodiment 128, wherein the SARS-CoV-2 spike protein comprises at least the amino acid substitutions, deletions or insertions at the positions corresponding to: N460, S486, F490, relative to the sequence of SEQ ID NO: 1.

Embodiment 146. The RNA of Embodiment 128, wherein the SARS-CoV-2 spike protein comprises at least the amino acid substitutions, deletions or insertions at the positions corresponding to: E180, T478, F486, relative to the sequence of SEQ ID NO: 1.

Embodiment 147. The RNA of Embodiment 128, wherein the SARS-CoV-2 spike protein comprises at least the amino acid substitutions, deletions or insertions at the positions corresponding to: N460, V83, H146, Q183, L368, relative to the sequence of SEQ ID NO: 1.

Embodiment 148. The RNA of Embodiment 128 to 147, wherein the SARS-CoV-2 spike protein comprises at least one further amino acid substitution, deletion or insertion at the position corresponding to E484, relative to the sequence of SEQ ID NO: 1.

Embodiment 149. The RNA of Embodiment 128 to 148, wherein the SARS-CoV-2 spike protein comprises at least one further amino acid substitution, deletion or insertion at the position corresponding to L425, relative to the sequence of SEQ ID NO: 1.

Embodiment 150. The RNA of Embodiment 128, wherein the SARS-CoV-2 spike protein comprises at least the amino acid substitutions, deletions or insertions at the positions corresponding to: T19, L24, P25, P26, A27, H69, V70, G142, V213, G339, R346, S371, S373, S375, T376, D405, R408, K417, N440, K444, L452, N460, S477, T478, E484, F486, Q498, N501, Y505, D614, H655, N679, P681, N764, D796, Q954, and N969, relative to the sequence of SEQ ID NO: 1.

Embodiment 151. The RNA of Embodiment 128, wherein the SARS-CoV-2 spike protein comprises at least the amino acid substitutions, deletions or insertions at the positions corresponding to: T19, L24, P25, P26, A27, V83, G142, Y144, H146, Q183, V213, G252, G339, R346, L368, S371, S373, S375, T376, D405, R408, K417, N440, V445P, G446, N460, S477, T478, E484, F486, F490, Q498, N501, Y505, D614, H655, N679, P681, N764, D796 and Q954, relative to the sequence of SEQ ID NO: 1.

Embodiment 152. The RNA of any one of the preceding Embodiments, wherein the SARS-CoV-2 spike protein comprises at least one further amino acid substitution at the position corresponding to: D614 or E484.

Embodiment 153. The RNA of any one of Embodiments 1 to 151, wherein the SARS-CoV-2 spike protein comprises at least one further amino acid substitution at the position corresponding to: E346, L452, E484, K417, G446, S477, F490, N501, D614, or P681.

Embodiment 154. The RNA of any one of the preceding Embodiments, wherein the SARS-CoV-2 spike protein comprises at least one further amino acid substitution, deletion or insertion selected from the group consisting of: L5F, L8V, P9L, S12F, S13I, L18F, T19I, T19R, T20I, T20N, L24del, P25del, P26del, P26S, A27S, H49Y, Q52R, A67V, H69del, V70del, V70F, G75V, T76I, D80A, T95I, V126A, C136F, D138Y, L141del, G142D, G142del, V143del, Y144del, Y144S, Y144T, Y144F, Y145del, Y145H, Y145N, ins145N, Y145S, Y145D, W152C, W152L, W152R, M153T, E154K, E156G, F157del, F157L, R158del, R190S, I210T, N211del, L212del, L212I, V213G, R214A, ins214EPE, ins214TDR, D215G, A222V, Q239K, E241del, L242del, A243del, L244del, H245Y, R246del, R246I, S247del, Y248del, L249del, T250del, P251del, G252del, D253G, D253N, S254F, W258L, Q321L, Q321S, G339D, V341I, R346K, R346S, R346T, A348T, N354D, R357K, S359N, V367F, S371F, S371L, S373P, S375F, T376A, K378R, K378S, P384L, R403K, D405N, R408I, R408S, Q409E, Q414K, K417N, K417T, A435S, N437S, N439K, N440K, V445A, V445F, V445I, G446A, G446S, G446V, G447V, Y449H, N450K, L452M, L452Q, L452R, Y453F, L455F, F456A, F456K, F456L, F456V, K458N, K458R, I472V, A475S, A475V, G476A, G476S, S477G, S477I, S477N, S477R, S477T, T478A, T478I, T478K, T478R, V483A, E484A, E484D, E484K, E484P, E484Q, G485R, G485S, F486I, F486L, F486V, N487I, F490L, F490S, F490Y, Q493K, Q493L, Q493R, S494A, S494L, S494P, G496S, Q498R, P499H, P499L, P499S, T500I, N501S, N501T, N501Y, G502V, V503F, V503I, G504D, Y505H, Y505W, Q506H, Q506K, Y508H, H519P, A522S, T547K, K558N, A570D, Q613H, D614G, H655Y, G669S, Q677H, N679K, P681H, P681R, R682del, R683del, A684del, R685del, I692V, A701V, T716I, T732A, T748K, N764K, G769V, D796H, D796Y, A831V, A845S, N856K, T859N, F888L, A899S, D936N, S939F, S940F, S943P, Q949R, D950N, Q954H, Q957R, N969K, L981F, S982A, T1027I, V1040F, Q1071H, E1092K, H1101Y, D1118H, S1147L, V1176F, N1187D, M1229I, C1254F, and P1263L, relative to the sequence of SEQ ID NO: 1.

Embodiment 155. The RNA of Embodiment 154, wherein the SARS-CoV-2 spike protein comprises at least the amino acid substitutions corresponding to: N460K and F490S, relative to the sequence of SEQ ID NO: 1.

Embodiment 156. The RNA of Embodiment 154, wherein the SARS-CoV-2 spike protein comprises at least the amino acid substitutions corresponding to: N460K, R346T and F490S, relative to the sequence of SEQ ID NO: 1.

Embodiment 157. The RNA of Embodiment 154, wherein the SARS-CoV-2 spike protein comprises at least the amino acid substitutions and deletion corresponding to: N460K, R346T, F490S and Y144del, relative to the sequence of SEQ ID NO: 1.

Embodiment 158. The RNA of Embodiment 154, wherein the SARS-CoV-2 spike protein comprises at least the amino acid substitutions corresponding to: N460K and D614G, relative to the sequence of SEQ ID NO: 1.

Embodiment 159. The RNA of Embodiment 154, wherein the SARS-CoV-2 spike protein comprises at least the amino acid substitutions corresponding to: N460K, D614G, and L452R, relative to the sequence of SEQ ID NO: 1.

Embodiment 160. The RNA of Embodiment 154, wherein the SARS-CoV-2 spike protein comprises at least the amino acid substitutions corresponding to: N460K, K444T, and R346T, relative to the sequence of SEQ ID NO: 1.

Embodiment 161. The RNA of 154, wherein the SARS-CoV-2 spike protein comprises at least the amino acid substitutions and deletion corresponding to: N460K, K444M, and Y144del, relative to the sequence of SEQ ID NO: 1.

Embodiment 162. The RNA of 154, wherein the SARS-CoV-2 spike protein comprises at least the amino acid substitutions and deletion corresponding to: N460K, G252V. and Y144del, relative to the sequence of SEQ ID NO: 1.

Embodiment 163. The RNA of Embodiment 154, wherein the SARS-CoV-2 spike protein comprises at least the amino acid substitutions corresponding to: G339H and R346T, relative to the sequence of SEQ ID NO: 1.

Embodiment 164. The RNA of Embodiment 154, wherein the SARS-CoV-2 spike protein comprises at least the amino acid substitutions corresponding to: F486S and R346T, relative to the sequence of SEQ ID NO: 1.

Embodiment 165. The RNA of Embodiment 154, wherein the SARS-CoV-2 spike protein comprises at least the amino acid substitutions corresponding to: F486S, D1199N, and R346T, relative to the sequence of SEQ ID NO: 1.

Embodiment 166. The RNA of Embodiment 154, wherein the SARS-CoV-2 spike protein comprises at least the amino acid substitutions corresponding to: N658S and R346T, relative to the sequence of SEQ ID NO: 1.

Embodiment 167. The RNA of Embodiment 154, wherein the SARS-CoV-2 spike protein comprises at least the amino acid substitutions corresponding to: T604I and L452R, relative to the sequence of SEQ ID NO: 1.

Embodiment 168. The RNA of Embodiment 154, wherein the SARS-CoV-2 spike protein comprises at least the amino acid substitutions corresponding to: K444M, A1020S, and D614G, relative to the sequence of SEQ ID NO: 1.

Embodiment 169. The RNA of Embodiment 154, wherein the SARS-CoV-2 spike protein comprises at least the amino acid substitutions corresponding to: V83A, H146Q, Q183E, V213E, G252V, G339H, L368I, V445P, N460K, F486S, and F490S, relative to the sequence of SEQ ID NO: 1.

Embodiment 170. The RNA of Embodiment 154, wherein the SARS-CoV-2 spike protein comprises at least the amino acid substitutions, deletions or insertions at the positions corresponding to: N460, F486 and F490, relative to the sequence of SEQ ID NO: 1.

Embodiment 171. The RNA of Embodiment 154, wherein the SARS-CoV-2 spike protein comprises at least the amino acid substitutions, deletions or insertions at the positions corresponding to: N460, F486, R346 and F490, relative to the sequence of SEQ ID NO: 1.

Embodiment 172. The RNA of Embodiment 154, wherein the SARS-CoV-2 spike protein comprises at least the amino acid substitutions, deletions or insertions at the positions corresponding to: N460, F486, R346, F490 and Y144, relative to the sequence of SEQ ID NO: 1.

Embodiment 173. The RNA of Embodiment 154, wherein the SARS-CoV-2 spike protein comprises at least the amino acid substitutions, deletions or insertions at the positions corresponding to: N460, F486, and D614, relative to the sequence of SEQ ID NO: 1.

Embodiment 174. The RNA of Embodiment 154, wherein the SARS-CoV-2 spike protein comprises at least the amino acid substitutions, deletions or insertions at the positions corresponding to: N460, F486, R346, F490, Y144, and D614, relative to the sequence of SEQ ID NO: 1.

Embodiment 175. The RNA of Embodiment 154, wherein the SARS-CoV-2 spike protein comprises at least one amino acid substitution, deletion or insertion at position from a SARS-CoV-2 variant spike protein derived from a SARS-CoV-2 variant selected from BQ1.1, BQ.1.2, BQ.1.18, XBB.1, XBB1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44.

Embodiment 176. The RNA of Embodiment 154, wherein the SARS-CoV-2 spike protein comprises at least the amino acid substitutions, corresponding to: T19I, L24del, P25del, P26del, A27S, H69del, V70del, G142D, V213G, G339D, R346T, S371F, S373P, S375F, T376A, D405N, R408S, K417N, N440K, K444T, L452R, N460K, S477N, T478K, E484A, F486V, Q498R, N501Y, Y505H, D614G, H655Y, N679K, P681H, N764K, D796Y, Q954H, and N969K, relative to the sequence of SEQ ID NO: 1.

Embodiment 177. The RNA of Embodiment 154, wherein the SARS-CoV-2 spike protein comprises at least the amino acid substitutions and deletion corresponding to: T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486S, F490S, Q498R, N501Y, Y505H, D614G, H655Y, N679K, P681H, N764K, D796Y, Q954H, and N969K, relative to the sequence of SEQ ID NO: 1.

Embodiment 178. The RNA of Embodiment 154, wherein the SARS-CoV-2 spike protein comprises at least the amino acid substitutions and deletion corresponding to: T19I, L24del, P25del, P26del, A27S, H69del, V70del, G142D, Y144del, V213G, G339D, R346T, S371F, S373P, S375F, T376A, D405N, R408S, K417N, N440K, K444T, L452R, N460K, S477N, T478K, E484A, F486V, Q498R, N501Y, Y505H, D614G, H655Y, N679K, P681H, N764K, D796Y, Q954H and N969K, relative to the sequence of SEQ ID NO: 1.

Embodiment 179. The RNA of Embodiment 154, wherein the SARS-CoV-2 spike protein comprises at least the amino acid substitutions and deletion corresponding to: T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, N764K, D796Y, Q954H, and N969K, relative to the sequence of SEQ ID NO: 1.

Embodiment 180. The RNA of Embodiment 154, wherein the SARS-CoV-2 spike protein comprises at least the amino acid substitutions and deletion corresponding to: T19I, P25S, G142D, Y144del, E156G, F157del, R158del, P209L, L212S, D215H, A222V, A243del, L244del, S371F, S373P, S375F, T376A, D405N, R408S, K417N, N440K, G446S, L452M, S477N, T478K, E484A, F486P, Q498R, N501Y, Y505H, D614G, H655Y, N679K, P681H, N703I, N764K, D796Y, Q954H, and N969K, relative to the sequence of SEQ ID NO: 1.

Embodiment 181. The RNA of Embodiment 154, wherein the SARS-CoV-2 spike protein comprises at least the amino acid substitutions and deletion corresponding to: T19I, L24del, P25del, P26del, A27S, V83A, G142D, E180V, Y144del, H146Q, Q183E, V213E, G252V, G339H, R346T, L368I, S371F, S373P, S375F, T376A, D405N, R408S, K417N, N440K, V445P, G446S, N460K, S477N, T478R, E484A, F486P, F490S, Q498R, N501Y, Y505H, D614G, H655Y, N679K, P681H, N764K, D796Y, Q954H and N969K, relative to the sequence of SEQ ID NO: 1.

Embodiment 182. The RNA of Embodiment 154, wherein the SARS-CoV-2 spike protein comprises at least the amino acid substitutions and deletion corresponding to: T19I, L24del, P25del, P26del, A27S, V83A, G142D, E180V, Y144del, H146Q, Q183E, V213E, G252V, G339H, R346T, L368I, S371F, S373P, S375F, T376A, D405N, R408S, K417N, N440K, V445P, G446S, N460K, S477N, T478R, E484A, F486P, F490S, Q498R, N501Y, Y505H, T547I D614G, H655Y, N679K, P681H, N764K, D796Y, Q954H and N969K, relative to the sequence of SEQ ID NO: 1.

Embodiment 183. The RNA of Embodiment 154, wherein the SARS-CoV-2 spike protein comprises at least the amino acid substitutions and deletion corresponding to: T19I, L24del, P25del, P26del, A27S, V83A, G142D, Y144del, H146Q, Q183E, V213E, D215H, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, N764K, D796Y, Q954H and N969K, relative to the sequence of SEQ ID NO: 1.

Embodiment 184. The RNA of Embodiment 154, wherein the SARS-CoV-2 spike protein comprises at least the amino acid substitutions and deletion corresponding to: T19I, L24del, P25del, P26del, A27S, V83A, G142D, Y144del, H146Q, Q183E, V213E, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, N764K, D796Y, Q954H and N969K, relative to the sequence of SEQ ID NO: 1.

Embodiment 185. The RNA of Embodiment 154, wherein the SARS-CoV-2 spike protein comprises at least the amino acid substitutions and deletion corresponding to: T19I, L24del, P25del, P26del, A27S, V83A, G142D, delY144, H146Q, Q183E, V213E, D253G, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, P521S, D614G, H655Y, N679K, P681H, N764K, D796Y, Q954H and N969K, relative to the sequence of SEQ ID NO: 1.

Embodiment 186. The RNA of Embodiment 154, wherein the SARS-CoV-2 spike protein comprises at least the amino acid substitutions and deletion corresponding to: T19I, L24del, P25del, P26del, A27S, D80Y, V83A, G142D, delY144, H146Q, Q183E, V213E, D253G, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, P521S, D614G, H655Y, N679K, P681H, N764K, D796Y, Q954H and N969K, relative to the sequence of SEQ ID NO: 1.

Embodiment 187. The RNA of Embodiment 154, wherein the SARS-CoV-2 spike protein comprises at least the amino acid substitutions and deletion corresponding to: T19I, L24del, P25del, P26del, A27S, V83A, G142D, Y144del, H146Q, Q183E, G184V, V213E, D253G, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, P521S, D614G, H655Y, N679K, P681H, N764K, D796Y, Q954H and N969K, relative to the sequence of SEQ ID NO: 1.

Embodiment 188. The RNA of Embodiment 154, wherein the SARS-CoV-2 spike protein comprises at least the amino acid substitutions and deletion corresponding to: L18F, T19R, R21G, T95I, W152L, E156G, F157del, R158del, F186L, V213G, G339D, S371F, S373P, S375F, T376A, D405N, R408S, K417N, N440K, G446D, S477N, L452R, T478K, E484A, F486P, Q498R, N501Y, Y505H, D614G, P621S, H655Y, N679K, P681H, A706V N764K, D796Y, Q954H and N969K, T1117I, relative to the sequence of SEQ ID NO: 1.

Embodiment 189. The RNA of Embodiment 154, wherein the SARS-CoV-2 spike protein comprises at least the amino acid substitutions and deletion corresponding to: T19I, L24del, P25del, P26del, A27S, V83A, G142D, Y144del, H146K, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, N764K, D796Y, Q954H and N969K, relative to the sequence of SEQ ID NO: 1.

Embodiment 190. The RNA of Embodiment 154, wherein the SARS-CoV-2 spike protein comprises at least the amino acid substitutions and deletion corresponding to: T19I, P25S, K97R, G142D, Y144del, E156G, F157del, R158del, P209L, L212S, D215H, A222V, A243del, L244del, S371F, S373P, S375F, T376A, D405N, R408S, K417N, N440K, G446S, S477N, T478K, E484A, F486P, Q498R, N501Y, Y505H, D614G, H655Y, N679K, P681H, N703I, N764K, D796Y, Q954H, and N969K, relative to the sequence of SEQ ID NO: 1.

Embodiment 191. The RNA of Embodiment 154, wherein the SARS-CoV-2 spike protein comprises at least the amino acid substitutions and deletion corresponding to: T19I, L24del, P25del, P26del, A27S, G142D, M153T, N164K, V213G, H245N, G257D, G339D, S371F, S373P, S375F, T376A, D405N, R408S, K417N, N440K, K444R, N450D, L452M, N460K, S477N, T478K, E484R, Q498R, N501Y, Y505H, D614G, H655Y, N679K, P681H, N764K, D796Y, Q954H, and N969K, relative to the sequence of SEQ ID NO: 1.

Embodiment 192. The RNA of Embodiment 154, wherein the SARS-CoV-2 spike protein comprises at least the amino acid substitutions and deletion corresponding to: T19I, L24del, P25del, P26del, A27S, G142D, K147E, W152R, F157L, I210V, V213G, G257S, G339H, R346T, K356T, S371F, S373P, S375F, T376A, D405N, R408S, K417N, N440K, G446S, N460K, S477N, T478K, E484A, F490S, Q498R, N501Y, Y505H, D614G, H655Y, N679K, P681H, N764K, D796Y, Q954H, and N969K, relative to the sequence of SEQ ID NO: 1.

Embodiment 193. The RNA of Embodiment 154, wherein the SARS-CoV-2 spike protein comprises at least the amino acid substitutions and deletion corresponding to: T19I, L24del, P25del, P26del, A27S, G142D, K147E, W152R, F157L, I210V, V213G, G257S, G339H, R346T, S371F, S373P, S375F, T376A, D405N, R408S, K417N, N440K, G446S, N460K, S477N, T478K, E484A, F486P, F490S, Q498R, N501Y, Y505H, D614G, H655Y, N679K, P681H, N764K, D796Y, Q954H, and N969K, relative to the sequence of SEQ ID NO: 1.

Embodiment 194. The RNA of Embodiment 154, wherein the SARS-CoV-2 spike protein comprises at least the amino acid substitutions corresponding to: T19I, L24del, P25del, P26del, A27S, H69del, V70del, G142D, V213G, G339D, S371F, S373P, S375F, T376A, D405N, R408S, K417N, N440K, L452R, S477N, T478K, E484A, F486V, Q498R, N501Y, Y505H, D614G, H655Y, N679K, P681H, N764K, D796Y, Q954H, N969K, and A1020S, relative to the sequence of SEQ ID NO: 1.

Embodiment 195. The RNA of Embodiment 154, wherein the SARS-CoV-2 spike protein comprises at least the amino acid substitutions corresponding to: T19I, L24del, P25del, P26del, A27S, G142D, K147E, W152R, F157L, I210V, V213G, G257S, G339H, S371F, S373P, S375F, T376A, D405N, R408S, K417N, N440K, G446S, N460K, S477N, T478K, E484A, Q498R, N501Y, Y505H, D614G, H655Y, N679K, P681H, N764K, D796Y, Q954H, and N969K, relative to the sequence of SEQ ID NO: 1.

Embodiment 196. The RNA of Embodiment 154, wherein the SARS-CoV-2 spike protein comprises at least the amino acid substitutions corresponding to: T19I, L24del, P25del, P26del, A27S, G142D, K147E, W152R, F157L, I210V V213G, G257S, G339H, S371F, S373P, S375F, T376A, D405N, R408S, K417N, N440K, G446S, N460K, S477N, T478K, E484A, Q498R, N501Y, Y505H, D574V, D614G, H655Y, N679K, P681H, N764K, D796Y, Q954H, and N969K, relative to the sequence of SEQ ID NO: 1.

Embodiment 197. The RNA of Embodiment 154, wherein the SARS-CoV-2 spike protein comprises at least the amino acid substitutions corresponding to: T19I, L24del, P25del, P26del, A27S, G142D, K147E, W152R, F157L, I210V, V213G, G257S, G339H, R346T, S371F, S373P, S375F, T376A, D405N, R408S, K417N, N440K, G446S, N460K, S477N, T478K, E484A, F486S, Q498R, N501Y, Y505H, D614G, H655Y, N679K, P681H, N764K, D796Y, Q954H, N969K, and D1199N, relative to the sequence of SEQ ID NO: 1.

Embodiment 198. The RNA of Embodiment 154, wherein the SARS-CoV-2 spike protein comprises at least the amino acid substitutions corresponding to: T19I, L24del, P25del, P26del, A27S, G142D, K147E, W152R, F157L, I210V, V213G, G257S, G339H, R346T, S371F, S373P, S375F, T376A, D405N, R408S, K417N, N440K, G446S, N460K, S477N, T478K, E484A, F486S, Q498R, N501Y, Y505H, D614G, H655Y, N679K, P681H, N764K, D796Y, Q954H, and N969K, relative to the sequence of SEQ ID NO: 1.

Embodiment 199. The RNA of Embodiment 154, wherein the SARS-CoV-2 spike protein comprises at least the amino acid substitutions corresponding to: T19I, L24del, P25del, P26del, A27S, G142D, K147E, W152R, F157L, I210V, V213G, G257S, G339H, R346T, S371F, S373P, S375F, T376A, D405N, R408S, K417N, N440K, G446S, N460K, S477N, T478K, E484A, F486S, F490S, Q498R, N501Y, Y505H, D614G, H655Y, N679K, P681H, N764K, D796Y, Q954H, and N969K, relative to the sequence of SEQ ID NO: 1.

Embodiment 200. The RNA of Embodiment 154, wherein the SARS-CoV-2 spike protein comprises at least the amino acid substitutions corresponding to: T19I, L24del, P25del, P26del, A27S, G142D, K147E, W152R, F157L, I210V, V213G, G257S, G339H, R346T, S371F, S373P, S375F, T376A, D405N, R408S, K417N, N440K, G446S, L452R, N460K, S477N, T478K, E484A, F486S, Q498R, N501Y, Y505H, T604I, D614G, H655Y, N679K, P681H, N764K, D796Y, Q954H, N969K, and D1199N, relative to the sequence of SEQ ID NO: 1.

Embodiment 201. The RNA of Embodiment 154, wherein the SARS-CoV-2 spike protein comprises at least the amino acid substitutions and deletion corresponding to: T19I, L24del, P25del, P26del, A27S, H69del, V70del, G142D, Y144del, V213G, G339D, S371F, S373P, S375F, T376A, D405N, R408S, K417N, N440K, K444M, L452R, N460K, S477N, T478K, E484A, F486V, Q498R, N501Y, Y505H, D614G, H655Y, N679K, P681H, N764K, D796Y, Q954H, and N969K, relative to the sequence of SEQ ID NO: 1.

Embodiment 202. The RNA of Embodiment 154, wherein the SARS-CoV-2 spike protein comprises at least the amino acid substitutions and deletion corresponding to: T19I, L24del, P25del, P26del, A27S, V83A, G142D, Y144del, H146Q, Q183E, V213E, G339H, R346T, L368I, S371F, S373P, S375F, T376A, D405N, R408S, K417N, N440K, V445P, G446S, S477N, T478K, V483A, E484A, F490V, Q493R, Q498R, N501Y, Y505H, D614G, H655Y, N679K, P681H, N764K, D796Y, G798D, Q954H, N969K, and S1003I, relative to the sequence of SEQ ID NO: 1.

Embodiment 203. The RNA of Embodiment 154, wherein the SARS-CoV-2 spike protein comprises at least the amino acid substitutions and deletion corresponding to: T19I, L24del, P25del, P26del, A27S, H69del, V70del, G142D, V213G, R346T, G339D, S371F, S373P, S375F, T376A, D405N, R408S, K417N, N440K, L452R, S477N, T478K, E484A, F486V, Q498R, N501Y, Y505H, D614G, H655Y, N679K, P681H, N764K, D796Y, Q954H and N969K, relative to the sequence of SEQ ID NO: 1.

Embodiment 204. The RNA of Embodiment 154, wherein the SARS-CoV-2 spike protein comprises at least the amino acid substitutions and deletion corresponding to: T19I, L24del, P25del, P26del, A27S, V83A, G142D, Y144del, H146Q, Q183E, V213E, G339H, R346T, L368I, D405N, N440K, V445P, G446S, S477N, T478K, V483A, E484A, F490V, Q493R, Q498R, N501Y, Y505H, D614G, H655Y, N679K, P681H, N764K, D796Y, G798D, Q954H, N969K, and S1003I, relative to the sequence of SEQ ID NO: 1.

Embodiment 205. The RNA of Embodiment 154, wherein the SARS-CoV-2 spike protein comprises at least the amino acid substitutions and deletion corresponding to: T19I, L24del, P25del, P26del, A27S, H69del, V70del, G142D, V213G, R346T, G339D, S371F, S373P, S375F, T376A, D405N, R408S, K417N, N440K, L452R, S477N, T478K, E484A, F486V, Q498R, N501Y, Y505H, D614G, H655Y, N679K, P681H, N764K, D796Y, Q954H, N969K and C1243F, relative to the sequence of SEQ ID NO: 1.

Embodiment 206. The RNA of Embodiment 154, wherein the SARS-CoV-2 spike protein comprises at least the amino acid substitutions and deletion corresponding to: T19I, delL24del, P25del, P26del, A27S, G142D, K147E, W152R, F157L, I210V V213G, G257S, G339H, R346T S371F, S373P, S375F, T376A, D405N, R408S, K417N, N440K, K444T, G446S, N460K, L452R, S477N, T478K, E484A, F486S, Q498R, N501Y, Y505H, D614G, H655Y, N679K, P681H, N764K, D796Y, Q954H and N969K, relative to the sequence of SEQ ID NO: 1.

Embodiment 207. The RNA of Embodiment 154, wherein the SARS-CoV-2 spike protein comprises at least the amino acid substitutions and deletion corresponding to: T19I, L24del, P25del, P26del, A27S, G142D, K147E, W152R, F157L, N185D, I210V V213G, G257S, G339H, R346T S371F, S373P, S375F, T376A, D405N, R408S, K417N, N440K, K444T, G446S, N460K, L452R, S477N, T478K, E484A, F486S Q493R, Q498R, N501Y, Y505H, D614G, H655Y, N679K, P681H, N764K, D796Y, Q954H and N969K, relative to the sequence of SEQ ID NO: 1.

Embodiment 208. The RNA of Embodiment 154, wherein the SARS-CoV-2 spike protein comprises at least the amino acid substitutions and deletion corresponding to: T19I, L24del, P25del, P26del, A27S, G142D, K147E, W152R, F157L, I210V V213G, G257S, G339H, R346T S371F, S373P, S375F, T376A, D405N, R408S, K417N, N440K, K444T, G446S, N460K, L452R, S477N, T478K, E484A, F486S Q493R, Q498R, N501Y, Y505H, D614G, H655Y, N679K, P681H, N764K, D796Y, T883I, Q954H and N969K, relative to the sequence of SEQ ID NO: 1.

Embodiment 209. The RNA of Embodiment 154, wherein the SARS-CoV-2 spike protein comprises at least the amino acid substitutions and deletion corresponding to: T19I, delL24del, L25del, P26del, A27S, H69del, V70del, G142D, Y144del, V213G, D253G, G339D, R346T, S371F, S373P, S375F, T376A, D405N, R408S, K417N, N440K, K444T, L452R, N460K, S477N, T478K, E484A, F486V, Q498R, N501Y, Y505H, D614G, H655Y, N679K, P681H, N764K, D796Y, Q954H, N969K and E1144Q, relative to the sequence of SEQ ID NO: 1.

Embodiment 210. The RNA of Embodiment 154, wherein the SARS-CoV-2 spike protein comprises at least the amino acid substitutions and deletion corresponding to: T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, Q613H, D614G, H655Y, N679K, P681H, N764K, D796Y, Q954H and N969K, relative to the sequence of SEQ ID NO: 1.

Embodiment 211. The RNA of Embodiment 154, wherein the SARS-CoV-2 spike protein comprises at least the amino acid substitutions and deletion corresponding to: T19I, L24del, P25del, P26del, A27S, V83A, G142D, Y144del, H146Q, Q183E, V213E, G252V, G339H, R346T, L368I, S371F, S373P, S375F, T376A, D405N, R408S, I410V, K417N, N440K, V445P, G446S, N460K, S477N, T478K, E484A, F486P, F490S, Q498R, N501Y, Y505H, P521S, D614G, H655Y, N679K, P681H, N764K, D796Y, Q954H and N969K, relative to the sequence of SEQ ID NO: 1.

Embodiment 212. The RNA of Embodiment 154, wherein the SARS-CoV-2 spike protein comprises at least the amino acid substitutions and deletion corresponding to: T19I, P25S, G142D, Y144del, E156G, F157del, R158del, P209L, L212S, D215H, A222V, A243del, L244del, S256L, R346S, S371F, S373P, S375F, T376A, D405N, R408S, K417N, N440K, G446S, L452R, S477N, T478K, E484A, F486P, Q498R, N501Y, Y505H, D614G, H655Y, N679K, P681H, N703I, N764K, D796Y, Q954H and N969K, relative to the sequence of SEQ ID NO: 1.

Embodiment 213. The RNA of Embodiment 154, wherein the SARS-CoV-2 spike protein comprises at least the amino acid substitutions and deletion corresponding to: T19I, delL24del, P25del, P26del, A27S, G142D, K147E, W152R, F157L, I210V V213G, D215G, G257S, G339H, R346T S371F, S373P, S375F, T376A, D405N, R408S, K417N, N440K, K444T, G446S, N460K, L452R, S477N, T478K, E484A, F486S, Q498R, N501Y, Y505H, Q613H, D614G, H655Y, N679K, P681H, N764K, D796Y, Q954H and N969K, relative to the sequence of SEQ ID NO: 1.

Embodiment 214. The RNA of Embodiment 154, wherein the SARS-CoV-2 spike protein comprises at least the amino acid substitutions and deletion corresponding to: T19I, L24del, P25del, P26del, A27S, Q52H, V83A, G142D, Y144del, H146Q, Q183E, V213E, G252V, G339H, R346T, L368I, S371F, S373P, S375F, T376A, D405N, R408S, K417N, N440K, V445P, G446S, F456L, N460K, S477N, T478K, E484A, F486P, F490S, Q498R, N501Y, Y505H, D614G, H655Y, N679K, P681H, N764K, D796Y, Q954H and N969K.

Embodiment 215. The RNA of Embodiment 154, wherein the SARS-CoV-2 spike protein comprises at least the amino acid substitutions and deletion corresponding to: T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, F456L, N460K, S477N, T478K, E484A, F486P, F490S, Q498R, N501Y, Y505H, D614G, H655Y, N679K, P681H, N764K, D796Y, Q954H and N969K.

Embodiment 216. The RNA of Embodiment 154, wherein the SARS-CoV-2 spike protein comprises at least the amino acid substitutions and deletion corresponding to: T19I, L24del, P25del, P26del, A27S, V83A, G142D, Y144del, H146Q, K182N, Q183E, V213E, D253G, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, P521S, D614G, H655Y, N679K, P681H, N764K, D796Y, Q954H and N969K.

Embodiment 217. The RNA of Embodiment 154, wherein the SARS-CoV-2 spike protein comprises at least the amino acid substitutions and deletion corresponding to: T19I, L24del, P25del, P26del, A27S, V83A, G142D, Y144del, H146Q, Q183E, V213E, D253G, G339H, R346T, L368I, S371F, S373P, S375F, T376A, D405N, R408S, K417N, N440K, V445P, G446S, N460K, S477N, T478Q, E484A, F486P, F490S, Q498R, N501Y, Y505H, P521S, D614G, H655Y, N679K, P681H, N764K, D796Y, Q954H and N969K.

Embodiment 218. The RNA of Embodiment 154, wherein the SARS-CoV-2 spike protein comprises at least the amino acid substitutions and deletion corresponding to: T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, L518V, D614G, H655Y, N679K, P681H, N764K, D796Y, Q954H and N969K.

Embodiment 219. The RNA of Embodiment 154, wherein the SARS-CoV-2 spike protein comprises at least the amino acid substitutions and deletion corresponding to: T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, A701V, N764K, D796Y, Q954H and N969K.

Embodiment 220. The RNA of Embodiment 154, wherein the SARS-CoV-2 spike protein comprises at least the amino acid substitutions and deletion corresponding to: T19I, L24del, P25del, P26del, A27S, G142D, K147N, M153T, N164K, V213G, H245N, G257D, G339D, G339H, R346T, S371F, S373P, S375F, T376A, D405N, R408S, K417N, N440K, K444R, G446S, N450D, L452M, N460K, S477N, T478K, E484R, F486S, Q498R, N501Y, Y505H, D614G, H655Y, N679K, P681H, N764K, D796Y, Q954H and N969K.

Embodiment 221. The RNA of Embodiment 154, wherein the SARS-CoV-2 spike protein comprises at least the amino acid substitutions and deletion corresponding to: T19I, L24del, P25del, P26del, A27S, V83A, G142D, E180V, Y144del, H146Q, Q183E, V213E, G252V, G339H, R346T, L368I, S371F, S373P, S375F, T376A, D405N, R408S, K417N, N440K, V445P, G446S, F456L, N460K, S477N, T478R, E484A, F486P, F490S, Q498R, N501Y, Y505H, D614G, H655Y, N679K, P681H, N764K, D796Y, Q954H and N969K.

Embodiment 222. The RNA of Embodiment 154, wherein the SARS-CoV-2 spike protein comprises at least the amino acid substitutions and deletion corresponding to: T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, E554K, D614G, H655Y, N679K, P681H, N764K, D796Y, Q954H and N969K.

Embodiment 223. The RNA of Embodiment 154, wherein the SARS-CoV-2 spike protein comprises at least the amino acid substitutions and deletion corresponding to: T19I, L24del, P25del, P26del, A27S, V83A, G142D, Y144del, H146Q, Q183E, Y200C, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, N764K, D796Y, Q954H and N969K.

Embodiment 224. The RNA of Embodiment 154, wherein the SARS-CoV-2 spike protein comprises at least the amino acid substitutions and deletion corresponding to: T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, Q675H, N764K, D796Y, Q954H and N969K.

Embodiment 225. The RNA of Embodiment 154, wherein the SARS-CoV-2 spike protein comprises at least the amino acid substitutions and deletion corresponding to: L18F, T19R, R21G, T95I, G142D, W152L, E156G, F157del, R158del, F186L, V213G, D253G, G339D, R346T, S371F, S373P, S375F, T376A, D405N, R408S, K417N, N440K, G446D, S477N, L452R T478K, E484A, F486P, Q498R, N501Y, Y505H, D614G, P621S, H655Y, N679K, P681H, A706V N764K, D796Y, Q954H, N969K, D1153Y and T1117I.

Embodiment 226. The RNA of Embodiment 154, wherein the SARS-CoV-2 spike protein comprises at least the amino acid substitutions and deletion corresponding to: T19I, L24del, P25del, P26del, A27S, V83A, G142D, Y144del, H146Q, Q183E, V213E, G252V, G339H, R346T, K356T, L368I, S371F, S373P, S375F, T376A, D405N, R408S, K417N, N440K, V445P, G446S, N460K, S477N, T478K, E484A, F486P, F490S, Q498R, N501Y, Y505H, T572I, D614G, H655Y, N679K, P681H, N764K, D796Y, Q954H and N969K.

Embodiment 227. The RNA of any one of the preceding Embodiments, wherein the SARS-CoV-2 spike protein comprises at least one further amino acid substitution corresponding to: D614G.

Embodiment 228. The RNA of any one of the preceding Embodiments, wherein the SARS-CoV-2 spike protein comprises at least one further amino acid substitution corresponding to: E484K or E484A.

Embodiment 229. The RNA of any one of the preceding Embodiments, wherein the SARS-CoV-2 spike protein comprises at least one further amino acid substitution corresponding to: L425R.

Embodiment 230. The RNA of any one of the preceding Embodiments, wherein the SARS-CoV-2 spike protein comprises at least the two further amino acid substitutions corresponding to: D614G and E484K.

Embodiment 231. The RNA of any one of the preceding Embodiments, wherein the SARS-CoV-2 spike protein comprises at least one further amino acid substitutions corresponding to: R346K, R346T, 346S, K417N, K417T, L452M, L452Q, L452R, S477N, V483A, E484A, E484K, F490S, F490V, F490Y, N501Y, D614G, P681H, or P681R.

Embodiment 232. The RNA of any one of the preceding Embodiments, wherein the SARS-CoV-2 spike protein comprises at least one further amino acid substitutions corresponding to: R346K, R346T, G446S, L452M, L452Q, L452R, or F490S.

Embodiment 233. The RNA of any one of the preceding Embodiments, wherein the spike protein (S) or the immunogenic fragment thereof comprises or consists of spike protein fragment S1 or RBD.

Embodiment 234. The RNA of any one of the preceding Embodiments, wherein the spike protein (S) is a pre-fusion stabilized spike protein (S_stab) comprising at least one pre-fusion stabilizing mutation.

Embodiment 235. The RNA of Embodiment 234, wherein the at least one pre-fusion stabilizing mutation comprises the following amino acid substitutions: K986P and V987P, relative to the sequence of SEQ ID NO: 1.

Embodiment 236. The RNA of any one of the preceding Embodiments, wherein the at least one coding sequence additionally encodes one or more heterologous peptide or protein elements selected from a signal peptide, a linker, a helper epitope, an antigen clustering element, a trimerization element, a transmembrane element, and/or a VLP-forming sequence.

Embodiment 237. The RNA of Embodiment 236, wherein the at least one heterologous peptide or protein element is a heterologous antigen-clustering element, a heterologous trimerization element, and/or a VLP-forming sequence.

Embodiment 238. The RNA of any one of the preceding Embodiments, wherein the at least one SARS-CoV-2 spike protein comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 1-2, 45-67, 159-164, 183-201, 264-276.

Embodiment 239. The RNA of any one of the preceding Embodiments, wherein the at least one SARS-CoV-2 spike protein comprises or consists of at least one of the amino acid sequences being identical or at least 90% identical to any one of SEQ ID NOs: 1-2, 45-67, 159-164, 183-201, 264-276.

Embodiment 240. The RNA of any one of the preceding Embodiments, wherein the at least one SARS-CoV-2 spike protein comprises or consists of at least one of the amino acid sequences being identical or at least 95% identical to any one of SEQ ID NOs: 1-2, 45-67, 159-164, 183-201, 264-276.

Embodiment 241. The RNA of any one of the preceding Embodiments, wherein the at least one SARS-CoV-2 spike protein comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 45-67.

Embodiment 242. The RNA of any one of the preceding Embodiments, wherein the at least one SARS-CoV-2 spike protein comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 159-164.

Embodiment 243. The RNA of any one of the preceding Embodiments, wherein the at least one SARS-CoV-2 spike protein comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 183-201.

Embodiment 244. The RNA of any one of the preceding Embodiments, wherein the at least one SARS-CoV-2 spike protein comprises or consists of at least one of the amino acid sequences being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 264-276.

Embodiment 245. The RNA of any one of the preceding Embodiments, wherein the at least one SARS-CoV-2 spike protein comprises or consists of at least one of the amino acid sequences being identical or at least 90% identical to any one of SEQ ID NOs: 45-67.

Embodiment 246. The RNA of any one of the preceding Embodiments, wherein the at least one SARS-CoV-2 spike protein comprises or consists of at least one of the amino acid sequences being identical or at least 90% identical to any one of SEQ ID NOs: 159-164.

Embodiment 247. The RNA of any one of the preceding Embodiments, wherein the at least one SARS-CoV-2 spike protein comprises or consists of at least one of the amino acid sequences being identical or at least 90% identical to any one of SEQ ID NOs: 183-201.

Embodiment 248. The RNA of any one of the preceding Embodiments, wherein the at least one SARS-CoV-2 spike protein comprises or consists of at least one of the amino acid sequences being identical or at least 90% identical to any one of SEQ ID NOs: 264-276.

Embodiment 249. The RNA of any one of the preceding Embodiments, wherein the at least one SARS-CoV-2 spike protein comprises or consists of at least one of the amino acid sequences being identical or at least 95% identical to any one of SEQ ID NOs: 45-67.

Embodiment 250. The RNA of any one of the preceding Embodiments, wherein the at least one SARS-CoV-2 spike protein comprises or consists of at least one of the amino acid sequences being identical or at least 95% identical to any one of SEQ ID NOs: 159-164.

Embodiment 251. The RNA of any one of the preceding Embodiments, wherein the at least one SARS-CoV-2 spike protein comprises or consists of at least one of the amino acid sequences being identical or at least 95% identical to any one of SEQ ID NOs: 183-201.

Embodiment 252. The RNA of any one of the preceding Embodiments, wherein the at least one SARS-CoV-2 spike protein comprises or consists of at least one of the amino acid sequences being identical or at least 95% identical to any one of SEQ ID NOs: 264-276.

Embodiment 253. The RNA of any one of the preceding Embodiments, wherein the at least one coding sequence is a codon modified coding sequence, wherein the amino acid sequence encoded by the at least one codon modified coding sequence is preferably not being modified compared to the amino acid sequence encoded by the corresponding reference coding sequence.

Embodiment 254. The RNA of Embodiment 253, wherein the at least one codon modified coding sequence is selected from C maximized coding sequence, CAI maximized coding sequence, human codon usage adapted coding sequence, G/C content modified coding sequence, and G/C optimized coding sequence, or any combination thereof.

Embodiment 255. The RNA of Embodiment 253 or 254, wherein the at least one codon modified coding sequence is a G/C optimized coding sequence, a human codon usage adapted coding sequence, or a G/C content modified coding sequence.

Embodiment 256. The RNA of any one of the preceding Embodiments, wherein the at least one coding sequence has a G/C content of at least about 50%, 55%, or 60%.

Embodiment 257. The RNA of any one of the preceding Embodiments, wherein the at least one coding sequence encodes an S protein, wherein the coding sequence comprises or consists of a G/C optimized coding sequence comprising a nucleic acid sequence at least 80% identical to any one of SEQ ID NOs: 70-80.

Embodiment 258. The RNA of any one of the preceding Embodiments, wherein the at least one coding sequence encodes an S protein, wherein the coding sequence comprises or consists of a G/C optimized coding sequence comprising a nucleic acid sequence at least 80% identical to any one of SEQ ID NOs: 165-170.

Embodiment 259. The RNA of any one of the preceding Embodiments, wherein the at least one coding sequence encodes an S protein, wherein the coding sequence comprises or consists of a G/C optimized coding sequence comprising a nucleic acid sequence at least 80% identical to any one of SEQ ID NOs: 202-220 or 259.

Embodiment 260. The RNA of any one of the preceding Embodiments, wherein the at least one coding sequence encodes an S protein, wherein the coding sequence comprises or consists of a G/C optimized coding sequence comprising a nucleic acid sequence at least 80% identical to any one of SEQ ID NOs: 277-289.

Embodiment 261. The RNA of any one of the preceding Embodiments, wherein the at least one coding sequence encodes an S protein, wherein the coding sequence comprises or consists of a G/C optimized coding sequence comprising a nucleic acid sequence at least 80% identical to SEQ ID NO: 262.

Embodiment 262. The RNA of any one of the preceding Embodiments, wherein the at least one coding sequence encodes an S protein, wherein the coding sequence comprises or consists of a G/C optimized coding sequence comprising a nucleic acid sequence at least 85% identical to any one of SEQ ID NOs: 70-80.

Embodiment 263. The RNA of any one of the preceding Embodiments, wherein the at least one coding sequence encodes an S protein, wherein the coding sequence comprises or consists of a G/C optimized coding sequence comprising a nucleic acid sequence at least 85% identical to any one of SEQ ID NOs: 165-170.

Embodiment 264. The RNA of any one of the preceding Embodiments, wherein the at least one coding sequence encodes an S protein, wherein the coding sequence comprises or consists of a G/C optimized coding sequence comprising a nucleic acid sequence at least 85% identical to any one of SEQ ID NOs: 202-220 or 259.

Embodiment 265. The RNA of any one of the preceding Embodiments, wherein the at least one coding sequence encodes an S protein, wherein the coding sequence comprises or consists of a G/C optimized coding sequence comprising a nucleic acid sequence at least 85% identical to any one of SEQ ID NOs: 277-289.

Embodiment 266. The RNA of any one of the preceding Embodiments, wherein the at least one coding sequence encodes an S protein, wherein the coding sequence comprises or consists of a G/C optimized coding sequence comprising a nucleic acid sequence at least 85% identical to SEQ ID NO: 262.

Embodiment 267. The RNA of any one of the preceding Embodiments, wherein the at least one coding sequence encodes an S protein, wherein the coding sequence comprises or consists of a G/C optimized coding sequence comprising a nucleic acid sequence at least 90% identical to any one of SEQ ID NOs: 70-80.

Embodiment 268. The RNA of any one of the preceding Embodiments, wherein the at least one coding sequence encodes an S protein, wherein the coding sequence comprises or consists of a G/C optimized coding sequence comprising a nucleic acid sequence at least 90% identical to any one of SEQ ID NOs: 165-170.

Embodiment 269. The RNA of any one of the preceding Embodiments, wherein the at least one coding sequence encodes an S protein, wherein the coding sequence comprises or consists of a G/C optimized coding sequence comprising a nucleic acid sequence at least 90% identical to any one of SEQ ID NOs: 202-220 or 259.

Embodiment 270. The RNA of any one of the preceding Embodiments, wherein the at least one coding sequence encodes an S protein, wherein the coding sequence comprises or consists of a G/C optimized coding sequence comprising a nucleic acid sequence at least 90% identical to any one of SEQ ID NOs: 277-289.

Embodiment 271. The RNA of any one of the preceding Embodiments, wherein the at least one coding sequence encodes an S protein, wherein the coding sequence comprises or consists of a G/C optimized coding sequence comprising a nucleic acid sequence at least 90% identical to SEQ ID NO: 262.

Embodiment 272. The RNA of any one of the preceding Embodiments, wherein the at least one coding sequence encodes an S protein, wherein the coding sequence comprises or consists of a G/C optimized coding sequence comprising a nucleic acid sequence at least 95% identical to any one of SEQ ID NOs: 70-80.

Embodiment 273. The RNA of any one of the preceding Embodiments, wherein the at least one coding sequence encodes an S protein, wherein the coding sequence comprises or consists of a G/C optimized coding sequence comprising a nucleic acid sequence at least 95% identical to any one of SEQ ID NOs: 165-170.

Embodiment 274. The RNA of any one of the preceding Embodiments, wherein the at least one coding sequence encodes an S protein, wherein the coding sequence comprises or consists of a G/C optimized coding sequence comprising a nucleic acid sequence at least 95% identical to any one of SEQ ID NOs: 202-220, or 259.

Embodiment 275. The RNA of any one of the preceding Embodiments, wherein the at least one coding sequence encodes an S protein, wherein the coding sequence comprises or consists of a G/C optimized coding sequence comprising a nucleic acid sequence at least 95% identical to any one of SEQ ID NOs: 277-289.

Embodiment 276. The RNA of any one of the preceding Embodiments, wherein the at least one coding sequence encodes an S protein, wherein the coding sequence comprises or consists of a G/C optimized coding sequence comprising a nucleic acid sequence at least 95% identical to SEQ ID NO: 262.

Embodiment 277. The RNA of any one of the preceding Embodiments, wherein the RNA comprises at least one poly(A) sequence, preferably comprising 30 to 200 adenosine nucleotides and/or at least one poly(C) sequence, preferably comprising 10 to 40 cytosine nucleotides.

Embodiment 278. The RNA of any one of the preceding Embodiments, wherein the RNA comprises at least one histone stem-loop.

Embodiment 279. The RNA of any one of the preceding Embodiments, wherein the RNA comprises at least one poly(A) sequence comprising 30 to 200 adenosine nucleotides, and/or wherein the 3' terminal nucleotide of said RNA is an adenosine.

Embodiment 280. The RNA of any one of the preceding Embodiments, wherein the RNA comprises at least one poly(A) sequence comprising at least 100 nucleotides.

Embodiment 281. The RNA of any one of the preceding Embodiments, wherein the RNA comprises at least one poly(A) sequence interrupted by a linker having no more than 2 consecutive adenosine nucleotides (e.g. A30-N10-A70).

Embodiment 282. The RNA of any one of the preceding Embodiments, wherein the RNA comprises at least one poly(A) sequence according to SEQ ID NO: 43, or a nucleotide sequence having at least 99%, 98%, 97%, 96%, 95%, 90%, 85%, or 80% identity to SEQ ID NO: 43.

Embodiment 283. The RNA of any one of the preceding Embodiments, wherein the RNA comprises at least one poly(A) sequence according to SEQ ID NO: 44, or a nucleotide sequence having at least 99%, 98%, 97%, 96%, 95%, 90%, 85%, or 80% identity to SEQ ID NO: 44.

Embodiment 284. The RNA of any one of the preceding Embodiments, wherein the RNA comprises at least two, three, or more poly(A) sequences.

Embodiment 285. The RNA of any one of the preceding Embodiments, wherein the RNA comprises at least one heterologous untranslated region (UTR).

Embodiment 286. The RNA of Embodiment 285, wherein the at least one heterologous untranslated region is selected from at least one heterologous 5'-UTR and/or at least one heterologous 3'-UTR.

Embodiment 287. The RNA of Embodiment 285 and 286, wherein the least one heterologous 3'-UTR comprises or consists of a nucleic acid sequence derived from a 3'-UTR of a gene selected from PSMB3, ALB7, CASP1, COX6B1, GNAS, NDUFA1 and RPS9, or from a homolog, a fragment or a variant of any one of these genes.

Embodiment 288. The RNA of Embodiment 285 and 286, wherein the at least one heterologous 5'-UTR comprises or consists of a nucleic acid sequence derived from a 5'-UTR of a gene selected from HSD17B4, RPL32, ASAH1, ATP5A1, MP68, NDUFA4, NOSIP, RPL31, SLC7A3, TUBB4B and UBQLN2, or from a homolog, a fragment or variant of any one of these genes.

Embodiment 289. The RNA of any one of the preceding Embodiments, comprising at least one heterologous 5'-UTR that comprises or consists of a nucleic acid sequence derived from a 5'-UTR from HSD17B4 and at least one heterologous 3'-UTR comprises or consists of a nucleic acid sequence derived from a 3'-UTR of PSMB3.

Embodiment 290. The RNA of any one of the preceding Embodiments, comprising, from 5' to 3':
i) a 5'-cap1 structure;
ii) a 5'-UTR derived from a 5'-UTR of a HSD17B4 gene, preferably according to SEQ ID NO: 4;
iii) the at least one coding sequence as defined herein;
iv) a 3'-UTR derived from a 3'-UTR of a PSMB3 gene, preferably according to SEQ ID NO: 20;
v) optionally, a histone stem-loop sequence; and
vi) a poly(A) sequence comprising about 100 A nucleotides, wherein the 3' terminal nucleotide of said RNA is an adenosine.

Embodiment 291. The RNA of Embodiment 285 and 286, wherein the least one heterologous 3'-UTR comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NOs: 31 or 32 or a fragment or a variant thereof.

Embodiment 292. The RNA of Embodiment 285 and 286, wherein the least one heterologous 5'-UTR comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to SEQ ID NOs: 11 or 12 or a fragment or a variant thereof.

Embodiment 293. The RNA of any one of Embodiments 1 to 286, comprising, from 5' to 3':
i) a 5'-cap1 structure;
ii) a 5'-UTR according to SEQ ID NO: 11;
iii) the at least one coding sequence as defined herein;
iv) a 3'-UTR according to SEQ ID NO: 31;
v) a poly(A) sequence according to SEQ ID NO: 44, or a nucleotide sequence having at least 99%, 98%, 97%, 96%, 95%, 90%, 85%, or 80% identity to the nucleotide sequence of SEQ ID NO: 44.

Embodiment 294. The RNA of Embodiment 285 and 286, wherein the least one heterologous 3'-UTR comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 23-30 or a fragment or a variant thereof.

Embodiment 295. The RNA of Embodiment 285 and 286, wherein the least one heterologous 5'-UTR comprises or consists of a nucleic acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 7-10 or a fragment or a variant thereof.

Embodiment 296. The RNA of any one of Embodiments 1 to 286, comprising, from 5' to 3':
i) a 5'-cap1 structure;
ii) a 5'-UTR according to SEQ ID NO: 7;
iii) the at least one coding sequence as defined herein;
iv) a 3'-UTR according to SEQ ID NO: 23;
vi) a poly(A) sequence comprising about 100 A nucleotides according to SEQ ID NO: 43 or a nucleotide sequence having at least 99%, 98%, 97%, 96%, 95%, 90%, 85%, or 80% identity to the nucleotide sequence SEQ ID NO: 43.

Embodiment 297. The RNA of any one of the preceding Embodiments, wherein the RNA comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 102-112 or a fragment or variant of any of these sequences.

Embodiment 298. The RNA of any one of the preceding Embodiments, wherein the RNA comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 171-176, or a fragment or variant of any of these sequences.

Embodiment 299. The RNA of any one of the preceding Embodiments, wherein the RNA comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 127-137 or a fragment or variant of any of these sequences.

Embodiment 300. The RNA of any one of the preceding Embodiments, wherein the RNA comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 177-182, or a fragment or variant of any of these sequences.

Embodiment 301. The RNA of any one of the preceding Embodiments, wherein the RNA comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 221-239 and 260, or a fragment or variant of any of these sequences.

Embodiment 302. The RNA of any one of the preceding Embodiments, wherein the RNA comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 240-258, or a fragment or variant of any of these sequences.

Embodiment 303. The RNA of any one of the preceding Embodiments, wherein the RNA comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 290-302, or a fragment or variant of any of these sequences.

Embodiment 304. The RNA of any one of the preceding Embodiments, wherein the RNA comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 303-315, or a fragment or variant of any of these sequences.

Embodiment 305. The RNA of any one of the preceding Embodiments, wherein the RNA comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 261, or a fragment or variant of any of these sequences.

Embodiment 306. The RNA of any one of the preceding Embodiments, wherein the RNA comprises or consists of a nucleic acid sequence which is identical or at least 70%, 80%, 85%, 86%, 87%, 88%, 89%, 90%, 91%, 92%, 93%, 94%, 95%, 96%, 97%, 98%, or 99% identical to a nucleic acid sequence selected from the group consisting of the SEQ ID NOs: 263, or a fragment or variant of any of these sequences.

Embodiment 307. The RNA of any one of the preceding Embodiments, wherein the RNA comprises or consists of a nucleic acid sequence which is at least 95% identical to a nucleic acid sequence selected from the group consisting of the SEQ ID NOs: 102 or 127 or a fragment or variant of any of these sequences.

Embodiment 308. The RNA of any one of the preceding Embodiments, wherein the RNA comprises or consists of a nucleic acid sequence which is at least 95% identical to a nucleic acid sequence selected from the group consisting of the SEQ ID NOs: 103 or 128 or a fragment or variant of any of these sequences.

Embodiment 309. The RNA of any one of the preceding Embodiments, wherein the RNA comprises or consists of a nucleic acid sequence which is at least 95% identical to a nucleic acid sequence selected from the group consisting of the SEQ ID NOs: 104 or 129 or a fragment or variant of any of these sequences.

Embodiment 310. The RNA of any one of the preceding Embodiments, wherein the RNA comprises or consists of a nucleic acid sequence which is at least 95% identical to a nucleic acid sequence selected from the group consisting of the SEQ ID NOs: 105 or 130 or a fragment or variant of any of these sequences.

Embodiment 311. The RNA of any one of the preceding Embodiments, wherein the RNA comprises or consists of a nucleic acid sequence which is at least 95% identical to a nucleic acid sequence selected from the group consisting of the SEQ ID NOs: 106 or 131 or a fragment or variant of any of these sequences.

Embodiment 312. The RNA of any one of the preceding Embodiments, wherein the RNA comprises or consists of a nucleic acid sequence which is at least 95% identical to a nucleic acid sequence selected from the group consisting of the SEQ ID NOs: 107 or 132 or a fragment or variant of any of these sequences.

Embodiment 313. The RNA of any one of the preceding Embodiments, wherein the RNA comprises or consists of a nucleic acid sequence which is at least 95% identical to a nucleic acid sequence selected from the group consisting of the SEQ ID NOs: 108 or 133 or a fragment or variant of any of these sequences.

Embodiment 314. The RNA of any one of the preceding Embodiments, wherein the RNA comprises or consists of a nucleic acid sequence which is at least 95% identical to a nucleic acid sequence selected from the group consisting of the SEQ ID NOs: 109 or 134 or a fragment or variant of any of these sequences.

Embodiment 315. The RNA of any one of the preceding Embodiments, wherein the RNA comprises or consists of a nucleic acid sequence which is at least 95% identical to a nucleic acid sequence selected from the group consisting of the SEQ ID NOs: 110 or 135 or a fragment or variant of any of these sequences.

Embodiment 316. The RNA of any one of the preceding Embodiments, wherein the RNA comprises or consists of a nucleic acid sequence which is at least 95% identical to a nucleic acid sequence selected from the group consisting of the SEQ ID NOs: 111 or 136 or a fragment or variant of any of these sequences.

Embodiment 317. The RNA of any one of the preceding Embodiments, wherein the RNA comprises or consists of a nucleic acid sequence which is at least 95% identical to a nucleic acid sequence selected from the group consisting of the SEQ ID NOs: 112 or 137 or a fragment or variant of any of these sequences.

Embodiment 318. The RNA of any one of the preceding Embodiments, wherein the RNA comprises or consists of a nucleic acid sequence which is at least 95% identical to a nucleic acid sequence selected from the group consisting of the SEQ ID NOs: 171 or 177 or a fragment or variant of any of these sequences.

Embodiment 319. The RNA of any one of the preceding Embodiments, wherein the RNA comprises or consists of a nucleic acid sequence which is at least 95% identical to a nucleic acid sequence selected from the group consisting of the SEQ ID NOs: 172 or 178 or a fragment or variant of any of these sequences.

Embodiment 320. The RNA of any one of the preceding Embodiments, wherein the RNA comprises or consists of a nucleic acid sequence which is at least 95% identical to a nucleic acid sequence selected from the group consisting of the SEQ ID NOs: 173 or 179 or a fragment or variant of any of these sequences.

Embodiment 321. The RNA of any one of the preceding Embodiments, wherein the RNA comprises or consists of a nucleic acid sequence which is at least 95% identical to a nucleic acid sequence selected from the group consisting of the SEQ ID NOs: 174 or 180 or a fragment or variant of any of these sequences.

Embodiment 322. The RNA of any one of the preceding Embodiments, wherein the RNA comprises or consists of a nucleic acid sequence which is at least 95% identical to a nucleic acid sequence selected from the group consisting of the SEQ ID NOs: 175 or 181 or a fragment or variant of any of these sequences.

Embodiment 323. The RNA of any one of the preceding Embodiments, wherein the RNA comprises or consists of a nucleic acid sequence which is at least 95% identical to a nucleic acid sequence selected from the group consisting of the SEQ ID NOs: 176 or 182 or a fragment or variant of any of these sequences.

Embodiment 324. The RNA of any one of the preceding Embodiments, wherein the RNA comprises or consists of a nucleic acid sequence which is at least 95% identical to a nucleic acid sequence selected from the group consisting of the SEQ ID NOs: 221 or 240 or a fragment or variant of any of these sequences.

Embodiment 325. The RNA of any one of the preceding Embodiments, wherein the RNA comprises or consists of a nucleic acid sequence which is at least 95% identical to a nucleic acid sequence selected from the group consisting of the SEQ ID NOs: 222 or 241 or a fragment or variant of any of these sequences.

Embodiment 326. The RNA of any one of the preceding Embodiments, wherein the RNA comprises or consists of a nucleic acid sequence which is at least 95% identical to a nucleic acid sequence selected from the group consisting of the SEQ ID NOs: 223 or 242 or a fragment or variant of any of these sequences.

Embodiment 327. The RNA of any one of the preceding Embodiments, wherein the RNA comprises or consists of a nucleic acid sequence which is at least 95% identical to a nucleic acid sequence selected from the group consisting of the SEQ ID NOs: 224 or 243 or a fragment or variant of any of these sequences.

Embodiment 328. The RNA of any one of the preceding Embodiments, wherein the RNA comprises or consists of a nucleic acid sequence which is at least 95% identical to a nucleic acid sequence selected from the group consisting of the SEQ ID NOs: 225 or 244 or a fragment or variant of any of these sequences.

Embodiment 329. The RNA of any one of the preceding Embodiments, wherein the RNA comprises or consists of a nucleic acid sequence which is at least 95% identical to a nucleic acid sequence selected from the group consisting of the SEQ ID NOs: 226 or 245 or a fragment or variant of any of these sequences.

Embodiment 330. The RNA of any one of the preceding Embodiments, wherein the RNA comprises or consists of a nucleic acid sequence which is at least 95% identical to a nucleic acid sequence selected from the group consisting of the SEQ ID NOs: 227 or 246 or a fragment or variant of any of these sequences.

Embodiment 331. The RNA of any one of the preceding Embodiments, wherein the RNA comprises or consists of a nucleic acid sequence which is at least 95% identical to a nucleic acid sequence selected from the group consisting of the SEQ ID NOs: 228 or 247 or a fragment or variant of any of these sequences.

Embodiment 332. The RNA of any one of the preceding Embodiments, wherein the RNA comprises or consists of a nucleic acid sequence which is at least 95% identical to a nucleic acid sequence selected from the group consisting of the SEQ ID NOs: 229 or 248 or a fragment or variant of any of these sequences.

Embodiment 333. The RNA of any one of the preceding Embodiments, wherein the RNA comprises or consists of a nucleic acid sequence which is at least 95% identical to a nucleic acid sequence selected from the group consisting of the SEQ ID NOs: 230 or 249 or a fragment or variant of any of these sequences.

Embodiment 334. The RNA of any one of the preceding Embodiments, wherein the RNA comprises or consists of a nucleic acid sequence which is at least 95% identical to a nucleic acid sequence selected from the group consisting of the SEQ ID NOs: 231 or 250 or a fragment or variant of any of these sequences.

Embodiment 335. The RNA of any one of the preceding Embodiments, wherein the RNA comprises or consists of a nucleic acid sequence which is at least 95% identical to a nucleic acid sequence selected from the group consisting of the SEQ ID NOs: 232 or 251 or a fragment or variant of any of these sequences.

Embodiment 336. The RNA of any one of the preceding Embodiments, wherein the RNA comprises or consists of a nucleic acid sequence which is at least 95% identical to a nucleic acid sequence selected from the group consisting of the SEQ ID NOs: 233 or 252 or a fragment or variant of any of these sequences.

Embodiment 337. The RNA of any one of the preceding Embodiments, wherein the RNA comprises or consists of a nucleic acid sequence which is at least 95% identical to a nucleic acid sequence selected from the group consisting of the SEQ ID NOs: 234 or 253 or a fragment or variant of any of these sequences.

Embodiment 338. The RNA of any one of the preceding Embodiments, wherein the RNA comprises or consists of a nucleic acid sequence which is at least 95% identical to a nucleic acid sequence selected from the group consisting of the SEQ ID NOs: 235 or 254 or a fragment or variant of any of these sequences.

Embodiment 339. The RNA of any one of the preceding Embodiments, wherein the RNA comprises or consists of a nucleic acid sequence which is at least 95% identical to a nucleic acid sequence selected from the group consisting of the SEQ ID NOs: 236 or 255 or a fragment or variant of any of these sequences.

Embodiment 340. The RNA of any one of the preceding Embodiments, wherein the RNA comprises or consists of a nucleic acid sequence which is at least 95% identical to a nucleic acid sequence selected from the group consisting of the SEQ ID NOs: 237 or 256 or a fragment or variant of any of these sequences.

Embodiment 341. The RNA of any one of the preceding Embodiments, wherein the RNA comprises or consists of a nucleic acid sequence which is at least 95% identical to a nucleic acid sequence selected from the group consisting of the SEQ ID NOs: 238 or 257 or a fragment or variant of any of these sequences.

Embodiment 342. The RNA of any one of the preceding Embodiments, wherein the RNA comprises or consists of a nucleic acid sequence which is at least 95% identical to a nucleic acid sequence selected from the group consisting of the SEQ ID NOs: 239 or 258 or a fragment or variant of any of these sequences.

Embodiment 343. The RNA of any one of the preceding Embodiments, wherein the RNA comprises or consists of a nucleic acid sequence which is at least 95% identical to a nucleic acid sequence selected from the group consisting of the SEQ ID NOs: 290 or 303 or a fragment or variant of any of these sequences.

Embodiment 344. The RNA of any one of the preceding Embodiments, wherein the RNA comprises or consists of a nucleic acid sequence which is at least 95% identical to a nucleic acid sequence selected from the group consisting of the SEQ ID NOs: 291 or 304 or a fragment or variant of any of these sequences.

Embodiment 345. The RNA of any one of the preceding Embodiments, wherein the RNA comprises or consists of a nucleic acid sequence which is at least 95% identical to a nucleic acid sequence selected from the group consisting of the SEQ ID NOs: 292 or 305 or a fragment or variant of any of these sequences.

Embodiment 346. The RNA of any one of the preceding Embodiments, wherein the RNA comprises or consists of a nucleic acid sequence which is at least 95% identical to a nucleic acid sequence selected from the group consisting of the SEQ ID NOs: 293 or 306 or a fragment or variant of any of these sequences.

Embodiment 347. The RNA of any one of the preceding Embodiments, wherein the RNA comprises or consists of a nucleic acid sequence which is at least 95% identical to a nucleic acid sequence selected from the group consisting of the SEQ ID NOs: 294 or 307 or a fragment or variant of any of these sequences.

Embodiment 348. The RNA of any one of the preceding Embodiments, wherein the RNA comprises or consists of a nucleic acid sequence which is at least 95% identical to a nucleic acid sequence selected from the group consisting of the SEQ ID NOs: 295 or 308 or a fragment or variant of any of these sequences.

Embodiment 349. The RNA of any one of the preceding Embodiments, wherein the RNA comprises or consists of a nucleic acid sequence which is at least 95% identical to a nucleic acid sequence selected from the group consisting of the SEQ ID NOs: 296 or 309 or a fragment or variant of any of these sequences.

Embodiment 350. The RNA of any one of the preceding Embodiments, wherein the RNA comprises or consists of a nucleic acid sequence which is at least 95% identical to a nucleic acid sequence selected from the group consisting of the SEQ ID NOs: 297 or 310 or a fragment or variant of any of these sequences.

Embodiment 351. The RNA of any one of the preceding Embodiments, wherein the RNA comprises or consists of a nucleic acid sequence which is at least 95% identical to a nucleic acid sequence selected from the group consisting of the SEQ ID NOs: 298 or 311 or a fragment or variant of any of these sequences.

Embodiment 352. The RNA of any one of the preceding Embodiments, wherein the RNA comprises or consists of a nucleic acid sequence which is at least 95% identical to a nucleic acid sequence selected from the group consisting of the SEQ ID NOs: 299 or 312 or a fragment or variant of any of these sequences.

Embodiment 353. The RNA of any one of the preceding Embodiments, wherein the RNA comprises or consists of a nucleic acid sequence which is at least 95% identical to a nucleic acid sequence selected from the group consisting of the SEQ ID NOs: 300 or 313 or a fragment or variant of any of these sequences.

Embodiment 354. The RNA of any one of the preceding Embodiments, wherein the RNA comprises or consists of a nucleic acid sequence which is at least 95% identical to a nucleic acid sequence selected from the group consisting of the SEQ ID NOs: 301 or 314 or a fragment or variant of any of these sequences.

Embodiment 355. The RNA of any one of the preceding Embodiments, wherein the RNA comprises or consists of a nucleic acid sequence which is at least 95% identical to a nucleic acid sequence selected from the group consisting of the SEQ ID NOs: 302 or 315 or a fragment or variant of any of these sequences.

Embodiment 356. The RNA of any one of the preceding Embodiments, wherein the RNA comprises or consists of a nucleic acid sequence which is at least 95% identical to a nucleic acid sequence selected from the group consisting of the SEQ ID NOs: 260 or a fragment or variant of any of these sequences.

Embodiment 357. The RNA of any one of the preceding Embodiments, wherein the RNA comprises or consists of a nucleic acid sequence which is at least 95% identical to a nucleic acid sequence selected from the group consisting of the SEQ ID NOs: 261 or a fragment or variant of any of these sequences.

Embodiment 358. The RNA of any one of the preceding Embodiments, wherein the RNA comprises or consists of a nucleic acid sequence which is at least 95% identical to a nucleic acid sequence selected from the group consisting of the SEQ ID NOs: 263 or a fragment or variant of any of these sequences.

Embodiment 359. The RNA of any one of the preceding Embodiments, wherein the RNA is an mRNA, a self-replicating RNA, a circular RNA, or a replicon RNA.

Embodiment 360. The RNA of any one of the preceding Embodiments, wherein the RNA is an mRNA.

Embodiment 361. The RNA of Embodiment 360, wherein the mRNA is not a replicon RNA or a self-replicating RNA.

Embodiment 362. The RNA of any one of the preceding Embodiments, wherein the RNA comprises a 5'-cap structure, preferably m7G, cap0, cap1, cap2, a modified cap0 or a modified cap1 structure, preferably a 5'-cap1 structure.

Embodiment 363. The RNA of any one of the preceding Embodiments, wherein the RNA that does not comprise a 1-methylpseudouridine substitution.

Embodiment 364. The RNA of any one of the preceding Embodiments, wherein the RNA that does not comprise chemically modified nucleotides.

Embodiment 365. The RNA of any one of the preceding Embodiments, wherein the RNA comprises a pseudouridine or 1-methylpseudouridine substitution.

Embodiment 366. The RNA of any one of the preceding Embodiments, wherein the RNA is an in vitro transcribed RNA, wherein RNA in vitro transcription has been performed in the presence of a sequence optimized nucleotide mixture and a cap analog.

Embodiment 367. The RNA of any one of the preceding Embodiments wherein the RNA is a synthetic RNA.

Embodiment 368. The RNA of any one of the preceding Embodiments wherein the RNA is an isolated RNA.

Embodiment 369. The RNA of any one of the preceding Embodiments, wherein the RNA is a purified RNA, preferably an RNA that has been purified by RP-HPLC, oligo d(T) purification and/or TFF.

Embodiment 370. The RNA of any one of the preceding Embodiments, wherein RNA is a purified RNA that has been purified by RP-HPLC, oligo d(T) purification and/or TFF and comprises about 5%, 10%, or 20% less double stranded RNA side products as an RNA that has not been purified with RP-HPLC, oligo d(T) purification and/or TFF.

Embodiment 371. A composition comprising the RNA as defined in Embodiments 1 to 370, wherein the composition optionally comprises at least one pharmaceutically acceptable carrier.

Embodiment 372. Composition according to Embodiment 371, wherein the composition is a multivalent composition comprising a plurality of RNAs as defined in any one of Embodiments 1 to 370.

Embodiment 373. Composition according to Embodiment 371, wherein the composition comprises at least 2, 3, 4, 5, 6, 7, 8, 9, 10 or even more different RNA species as defined in any one of Embodiments 1 to 370.

Embodiment 374. Composition of Embodiment 371 to 373, wherein the composition is a multivalent composition comprising a plurality of RNAs comprising at least one further RNA in addition to the RNA as defined in any one of Embodiments 1 to 370.

Embodiment 375. Composition of Embodiment 371 to 374, wherein each RNA of the plurality of RNAs or of the at least more than one RNA of the multivalent composition encodes a different spike protein, preferably a prefusion stabilized spike protein.

Embodiment 376. Composition of Embodiment 374 to 375, wherein the different spike proteins or prefusion stabilized spike proteins are or are derived from different SARS-CoV-2 virus variants.

Embodiment 377. Composition of Embodiment 376, wherein at least one of the different spike proteins or prefusion stabilized spike proteins is or is derived from B.1.1.529, BA.1, BA.2, BA.4, BA.5, B.1.1.7 (Alpha), B.1.351 (Beta), P.1 (Gamma), B.1.617.2 (Delta), and/or C.37 (Lambda) variant.

Embodiment 378. Composition of Embodiment 376 or 377, wherein at least one of the different spike proteins or prefusion stabilized spike proteins is or is derived from an omicron variant, preferably selected from a B.1.1.529, BA.1, BA.2, BA.4, and/or BA.5 variant.

Embodiment 379. Composition of Embodiment 376, wherein at least one of the different spike protein or prefusion stabilized spike protein is or is derived from SARS-CoV-2/Wuhan/WIV05/2019.

Embodiment 380. Composition of Embodiment 379, wherein at least one prefusion stabilized spike protein is or is derived from SARS-CoV-2/Wuhan/WIV05/2019 according to SEQ ID NO:2.

Embodiment 381. Composition of Embodiment 376, wherein at least one of the different spike protein or prefusion stabilized spike protein comprises the amino acid substitution D614G, relative to the sequence of SEQ ID NO 1.

Embodiment 382. Composition of Embodiment 376 to 381, wherein at least one of the different spike proteins or prefusion stabilized spike proteins comprises or consists of at least one of the amino acid sequences being identical or at least 95% identical to any one of SEQ ID NOs: 56-67, 159-164.

Embodiment 383. Composition of Embodiment 376 to 382, wherein at least one of the RNAs encoding different spike proteins or prefusion stabilized spike proteins comprises or consists of at least one of the nucleic acid sequences being identical or at least 95% identical to any one of SEQ ID NOs: 81-101, 113-126, 139-158.

Embodiment 384. Composition of Embodiment 372 to 382, wherein the multivalent composition comprises at least i) one RNA species as defined in any one of Embodiments 1 to 370 and ii) one further RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 1, 2, 56-67.

Embodiment 385. Composition of Embodiment 372 to 383, wherein the multivalent composition comprises at least i) one RNA species as defined in any one of Embodiments 1 to 370 and ii) one further RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 10.

Embodiment 386. Composition of Embodiment 372 to 383, wherein the multivalent composition comprises at least i) one RNA species as defined in any one of Embodiments 1 to 370 and ii) one further RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 56.

Embodiment 387. Composition of Embodiment 372 to 383, wherein the multivalent composition comprises at least i) one RNA species as defined in any one of Embodiments 1 to 370 and ii) one further RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 58.

Embodiment 388. Composition of Embodiment 372 to 383, wherein the multivalent composition comprises at least i) one RNA species as defined in any one of Embodiments 1 to 370 and ii) one further RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 62.

Embodiment 389. Composition of Embodiment 372 to 383, wherein the multivalent composition comprises at least i) one RNA species as defined in any one of Embodiments 1 to 370 and ii) one further RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO 66.

Embodiment 390. Composition of Embodiment 372 to 383, wherein the multivalent composition comprises at least i) one RNA species as defined in any one of Embodiments 1 to 370 and ii) one further RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 67.

Embodiment 391. Composition of Embodiment 372 to 383, wherein the multivalent composition comprises at least i) one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 45-55, 159-164, and ii) one further RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to any one of SEQ ID NOs: 1, 2, 56-67.

Embodiment 392. Composition of Embodiment 372 to 383, wherein the multivalent composition comprises at least i) one RNA species comprising a coding sequence encoding an amino acid sequence being identical or at least 95%, 96%, 97%, 98%, or 99% identical to any one of SEQ ID NOs: 45-55, 159-164, 183-201, 264-276 and ii) one further RNA species comprising a coding sequence encoding an amino acid sequence being identical or at least 95%, 96%, 97%, 98%, or 99% identical to SEQ ID NO: 1.

Embodiment 393. Composition of Embodiment 372 to 383, wherein the multivalent composition comprises at least i) one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 45, and ii) one further RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 1.

Embodiment 394. Composition of Embodiment 372 to 383, wherein the multivalent composition comprises at least i) one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 162, and ii) one further RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 1.

Embodiment 395. Composition of Embodiment 372 to 383, wherein the multivalent composition comprises at least
i) one RNA species comprising a coding sequence encoding an amino acid sequence being identical or at least 95%, 96%, 97%, 98%, or 99% identical to any one of SEQ ID NOs: 45-55, 159-164, 183-201, 264-276 and
ii) one further RNA species comprising a coding sequence encoding an amino acid sequence being identical or at least 95%, 96%, 97%, 98%, or 99% identical to SEQ ID NO: 2.

Embodiment 396. Composition of Embodiment 372 to 383, wherein the multivalent composition comprises at least
i) one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 45, and
ii) one further RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 2.

Embodiment 397. Composition of Embodiment 372 to 383, wherein the multivalent composition comprises at least
i) one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 162, and
ii) one further RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 2.

Embodiment 398. Composition of Embodiment 372 to 383, wherein the multivalent composition comprises at least
i) one RNA species comprising a coding sequence encoding an amino acid sequence being identical or at least 95%, 96%, 97%, 98%, or 99% identical to any one of SEQ ID NOs: 45-55, 159-164, 183-201, 264-276 and
ii) one further RNA species comprising a coding sequence encoding an amino acid sequence being identical or at least 95%, 96%, 97%, 98%, or 99% identical to SEQ ID NO: 56.

Embodiment 399. Composition of Embodiment 372 to 383, wherein the multivalent composition comprises at least
i) one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 45, and
ii) one further RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 56.

Embodiment 400. Composition of Embodiment 372 to 383, wherein the multivalent composition comprises at least
i) one RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 162, and
ii) one further RNA species comprising a coding sequence encoding an amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO: 56.

Embodiment 401. Composition of Embodiment 372 to 383, wherein the multivalent composition comprises at least
i) one RNA species comprising a coding sequence encoding an amino acid sequence being identical or at least 95%, 96%, 97%, 98%, or 99% identical to any one of SEQ ID NOs: 45-55, 159-164, 183-201, 264-276 and
ii) one further RNA species comprising a coding sequence encoding an amino acid sequence being identical or at least 95%, 96%, 97%, 98%, or 99% identical to SEQ ID NO: 58.

Embodiment 402. Composition of Embodiment 372 to 383, wherein the multivalent composition comprises at least
i) one RNA species comprising a coding sequence encoding an amino acid sequence being identical or at least 95%, 96%, 97%, 98%, or 99% identical to any one of SEQ ID NOs: 45-55, 159-164, 183-201, 264-276 and
ii) one further RNA species comprising a coding sequence encoding an amino acid sequence being identical or at least 95%, 96%, 97%, 98%, or 99% identical to SEQ ID NO: 62.

Embodiment 403. Composition of Embodiment 372 to 383, wherein the multivalent composition comprises at least
i) one RNA species comprising a coding sequence encoding an amino acid sequence being identical or at least 95%, 96%, 97%, 98%, or 99% identical to any one of SEQ ID NOs: 45-55, 159-164, 183-201 and
ii) one further RNA species comprising a coding sequence encoding an amino acid sequence being identical or at least 95%, 96%, 97%, 98%, or 99% identical to SEQ ID NO: 66.

Embodiment 404. Composition of Embodiment 372 to 383, wherein the multivalent composition comprises at least
i) one RNA species comprising a coding sequence encoding an amino acid sequence being identical or at least, 95%, 96%, 97%, 98%, or 99% identical to any one of SEQ ID NOs: 45-55, 159-164, 183-201, 264-276 and
ii) one further RNA species comprising a coding sequence encoding an amino acid sequence being identical or at least 95%, 96%, 97%, 98%, or 99% identical to SEQ ID NO: 67.

Embodiment 405. Composition of any one of Embodiments 371 to 404, wherein the RNA is encapsulated in a lipid-based carrier selected from the group consisting of liposomes, lipid nanoparticles (LNPs), lipoplexes, and nanoliposomes, preferably wherein the RNA is encapsulated in a lipid nanoparticle (LNP).

Embodiment 406. Composition of Embodiment 405, wherein said lipid-based carrier comprises an ionizable cationic lipid, a phospholipid, a structural lipid, and an aggregation reducing lipid, preferably wherein said lipid-based carrier is a lipid nanoparticle (LNP).

Embodiment 407. Composition of Embodiments 405 or 406, wherein said lipid-based carrier comprises an ionizable cationic lipid, a phospholipid, preferably 1,2-distearoyl-sn-glycero-3-phosphocholine (DSPC), cholesterol, and a PEG lipid, preferably wherein said lipid-based carrier is a lipid nanoparticle (LNP).

Embodiment 408. Composition of any one of Embodiments 405 to 407, wherein the neutral lipid is 1,2-distearoyl-sn-glycero-3-phosphocholine (DSPC), preferably wherein the molar ratio of the ionizable cationic lipid to DSPC is in the range from about 2:1 to about 8:1.

Embodiment 409. Composition of any one of Embodiments 405 to 408, wherein the steroid is cholesterol, preferably wherein the molar ratio of the ionizable cationic lipid to cholesterol is in the range from about 2:1 to about 1:1.

Embodiment 410. Composition of any one of Embodiments 405 to 409, wherein the lipid-based carrier, preferably LNP, comprises an ionizable cationic lipid according to formula X-1:

Embodiment 413. Composition of any one of Embodiments 405 to 412, wherein the lipid-based carrier, preferably LNP, comprises (i) at least one ionizable cationic lipid, preferably a lipid of formula X-1 (SM-102);

(ii) at least one neutral lipid, preferably 1,2-distearoyl-sn-glycero-3-phosphocholine (DSPC);

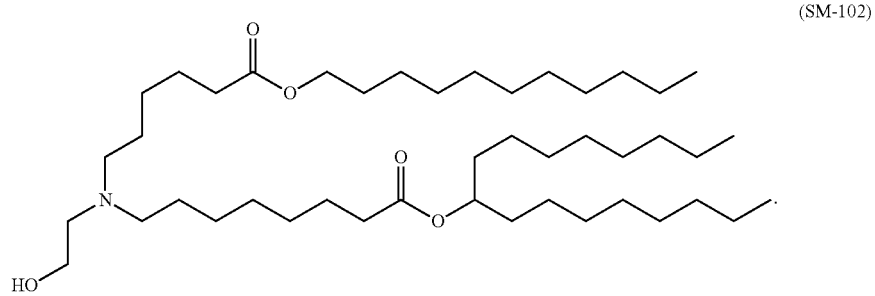 [SMILES: CCCCCCCCCCCOC(=O)CCCCCN(CCO)CCCCCCCC(=O)OC(CCCCCCCC)CCCCCCCC]

(SM-102)

Embodiment 411. Composition of any one of Embodiments 405-410, wherein the lipid-based carrier, preferably LNP, comprises a PEG lipid comprising 1,2-dimyristoyl-rac-glycero-3-methoxypolyethylene glycol-2000 (PEG2000 DMG).

Embodiment 412. Composition of any one of Embodiments 405 to 411, wherein the lipid-based carrier, preferably LNP, comprises (i) at least one ionizable cationic lipid, preferably a lipid of formula X-1 (SM-102);

(ii) at least one neutral lipid, preferably 1,2-distearoyl-sn-glycero-3-phosphocholine (DSPC);

(iii) at least one steroid or steroid analogue, preferably cholesterol; and (iv) at least one polymer conjugated lipid, preferably PEG2000 DMG, (iii) at least one steroid or steroid analogue, preferably cholesterol; and (iv) at least one polymer conjugated lipid, preferably PEG2000 DMG, wherein (i) to (iv) are in a molar ratio of about 20-60% ionizable cationic lipid, 5-25% neutral lipid, 25-55% sterol, and 0.5-15% PEG-lipid.

Embodiment 414. Composition of Embodiment 412 to 413, wherein (i) to (iv) are in a molar ratio of about 47-50:9-14:36-42:1-2, preferably about 48.5:11.1:38.9:1.5.

Embodiment 415. Composition of any one of Embodiments 405 to 414, wherein the LNP comprises an ionizable cationic lipid according to formula (III-3):

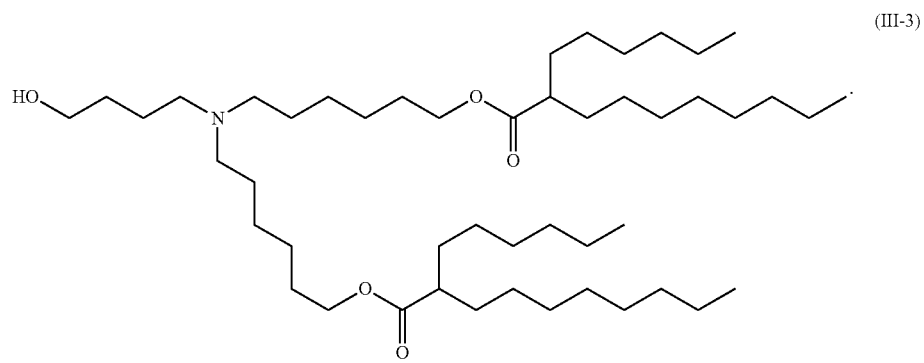 [SMILES: CCCCCCCCC(CCCCCC)C(=O)OCCCCCCN(CCCCO)CCCCCCOC(=O)C(CCCCCC)CCCCCCCC]

(III-3)

wherein (i) to (iv) are in a molar ratio of about 20-60% ionizable cationic lipid, 5-25% neutral lipid, 25-55% sterol, and 0.5-15% PEG-lipid.

Embodiment 416. Composition of any one of Embodiments 405 to 415, wherein the LNP comprises a PEG lipid of formula (IVa):

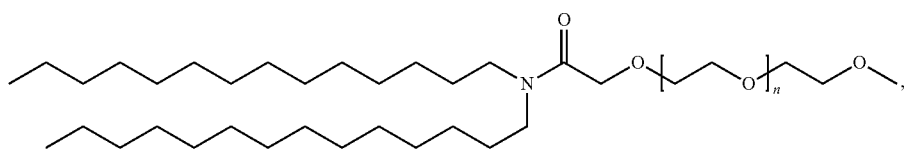

(IVa)

wherein n has a mean value ranging from 30 to 60, preferably wherein n has a mean value of about 45, 46, 47, 48, 49, 50, 51, 52, 53, 54, most preferably wherein n has a mean value of 49 or 45.

Embodiment 417. Composition of any one of Embodiments 405 to 410 or Embodiments 412 to 416, wherein the LNP comprises a PEG lipid of formula (IVa):

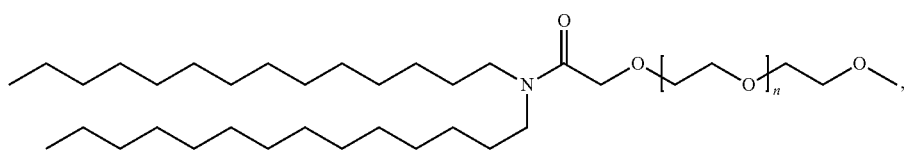

(IVa)

wherein n is an integer selected such that the average molecular weight of the PEG lipid is about 2500 g/mol.

Embodiment 418. Composition of any one of Embodiments 405 to 410 or Embodiments 412 to 416, wherein the LNP comprises
(i) at least one ionizable cationic lipid, preferably a lipid of formula (III), more preferably lipid III-3;
(ii) at least one neutral lipid, preferably 1,2-distearoyl-sn-glycero-3-phosphocholine (DSPC);
(iii) at least one steroid or steroid analogue, preferably cholesterol; and
(iv) at least one polymer conjugated lipid, preferably a PEG-lipid derived from formula (IVa, with n=49),
wherein (i) to (iv) are in a molar ratio of about 20-60% ionizable cationic lipid, 5-25% neutral lipid, 25-55% sterol, and 0.5-15% PEG-lipid.

Embodiment 419. Composition of any one of Embodiments 405 to 410 or Embodiments 412 to 416, wherein the LNP comprises
(i) at least one ionizable cationic lipid, preferably a lipid of formula (III), more preferably lipid III-3;
(ii) at least one neutral lipid, preferably 1,2-distearoyl-sn-glycero-3-phosphocholine (DSPC);
(iii) at least one steroid or steroid analogue, preferably cholesterol; and
(iv) at least one polymer conjugated lipid, preferably a PEG-lipid derived from formula (IVa, with n=45),
wherein (i) to (iv) are in a molar ratio of about 20-60% ionizable cationic lipid, 5-25% neutral lipid, 25-55% sterol, and 0.5-15% PEG-lipid.

Embodiment 420. Composition of Embodiments 412 to 413 or Embodiments 418 to 419, wherein (i) to (iv) are in a molar ratio of about 50:10:38.5:1.5, preferably 47.4:10:40.9: 1.7 or 47.5:10:40.7:1.8.

Embodiment 421. Composition of any one of Embodiments 405 to 420, wherein the wt/wt ratio of lipid to RNA is from about 10:1 to about 60:1, preferably from about 20:1 to about 30:1, for example about 25:1.

Embodiment 422. Composition of any one of Embodiments 405 to 421, wherein the n/p ratio of the LNPs encapsulating the RNA is in a range from about 1 to about 10, preferably in a range from about 5 to about 7, more preferably about 6.

Embodiment 423. Composition of any one of Embodiments 405 to 422, wherein at least about 80%, 85%, 90%, 95% of lipid-based carriers have a spherical morphology, preferably comprising a solid core or partially solid core.

Embodiment 424. Composition of any one of Embodiments 405 to 423, wherein the composition has a pH in a range of about pH 7.0 to about pH 8.0, preferably of about pH 7.4.

Embodiment 425. Composition of any one of Embodiments 405 to 424, wherein the composition is a lyophilized composition.

Embodiment 426. Composition of any one of Embodiments 405 to 425, wherein the RNA and lipid-based carrier encapsulating the RNA have been purified by at least one purification step, preferably by at least one step of TFF and/or at least one step of clarification and/or at least one step of filtration.

Embodiment 427. A vaccine comprising the RNA of any one of Embodiments 1 to 370, and/or the composition of any one of Embodiments 371 to 426.

Embodiment 428. A vaccine of Embodiment 427, wherein the vaccine elicits an adaptive immune response, preferably a protective adaptive immune response against a coronavirus, preferably against coronavirus SARS-CoV-2.

Embodiment 429. A vaccine of Embodiment 427 and 428, wherein the vaccine elicits an adaptive immune response, preferably a protective adaptive immune response against more than one SARS-CoV-2 variant, preferably selected from B.1.1.529 (Omicron), BA.1 (Omicron), BA.2 (Omicron), BA.4 (Omicron), BA.5 (Omicron), B.1.1.7 (Alpha), B.1.351 (Beta), P.1 (Gamma), B.1.617.2 (Delta), C.37 (Lambda), BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1 FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44.

Embodiment 430. A vaccine of Embodiment 427 to 429, wherein the vaccine is a multivalent vaccine comprising a plurality or at least more than one of the RNA as defined in any one of Embodiments 1 to 309, or a plurality or at least more than one of the compositions as defined in any one of Embodiments 310 to 365.

Embodiment 431. A Kit or kit of parts, comprising the RNA of any one of Embodiments 1 to 370, and/or the composition of any one of Embodiments 371 to 426, and/or the vaccine of Embodiment 427 to 430, optionally comprising a liquid vehicle for solubilising, and, optionally, technical instructions providing information on administration and dosage of the components.

Embodiment 432. The RNA of any one of Embodiments 1 to 370, the composition of any one of Embodiments 371 to 426, the vaccine of Embodiment 427 to 430, the kit or kit of parts of Embodiment 431, for use as a medicament.

Embodiment 433. The RNA of any one of Embodiments 1 to 370, the composition of any one of Embodiments 371 to 426, the vaccine of Embodiment 427 to 430, the kit or kit of parts of Embodiment 431, for use in the treatment or prophylaxis of an infection with a coronavirus, preferably a SARS-CoV-2 coronavirus, or of a disorder related to such an infection, preferably COVID-19.

Embodiment 434. A method of treating or preventing a disorder, wherein the method comprises applying or administering to a subject in need thereof the RNA of any of Embodiments 1 to 370, the composition of any one of Embodiments 371 to 426, the vaccine of Embodiment 427 to 430, the kit or kit of parts of Embodiment 431.

Embodiment 435. The method of treating or preventing a disorder of Embodiment 434, wherein the disorder is an infection with a coronavirus, preferably a SARS-CoV-2 coronavirus, or a disorder related to such an infection, preferably COVID-19.

Embodiment 436. The method of treating or preventing a disorder of Embodiment 434 or 435, further defined as method of preventing a SARS-CoV-2 coronavirus infection or a disorder related to such an infection, preferably COVID-19.

Embodiment 437. The method of treating or preventing a disorder of Embodiment 436, further defined as method of preventing a SARS-CoV-2 coronavirus infection or a disorder related to such an infection, wherein the infection is with a SARS-CoV-2 isolate preferably selected from list consisting of B.1.1.529 (Omicron), BA.1 (Omicron), BA.2 (Omicron), BA.4 (Omicron), BA.5 (Omicron), B.1.1.7 (Alpha), B.1.351 (Beta), P.1 (Gamma), B.1.617.2 (Delta), C.37 (Lambda), BQ1.1, BQ.1.2, BQ.1.18, XBB.1, XBB.1.5, XBB.1.16, XBB.1.16.1, XBB.1.17.1, XBB.1.22, XBB.2.3, XBB.2.3.1, XBB.2.3.2, XAY-2, FD2, XBC.1, XBC.2, XBF, CM.2, BN.1, BF.5, BA.2.75, BA.2.75.1, BA.2.75.2, BM1.1, BM.1.1.1, CA.1, BU.1, BJ.1, BJ.1.v1, BF.7, BF.7.14, CH.1.1, CH.1.1.1, CH.1.1.2, DU.1, EG.1/EG.1.3, EU.1.1, FK.1, XBC.1.6, EG.5.1, EG.5/FE.1, XBB.2.3.3, XBB.2.4, GB.1, FL.1/FL.1.3, FV.1, XBB.1.16.6, XBB.1.19.1, XBB.1.22.1, EL.1, XAY-1.1.1 and/or XBB.1.5.44.

Embodiment 438. The method of treating or preventing a disorder of Embodiment 434, further defined as method of preventing a SARS-CoV-2 coronavirus infection or a disorder related to such an infection, wherein the infection is with a SARS-CoV-2 isolate comprising an amino acid substitution, deletion or insertion in accordance with any one of Embodiments 1 to 233.

Embodiment 439. The method of treating or preventing a disorder of any one of Embodiments 434 to 438, wherein the subject in need is a mammalian subject, preferably a human subject.

Embodiment 440. The method of treating or preventing a disorder of Embodiment 439, wherein the human subject is an elderly human subject, preferably of an age of at least 50, 60, 65, or 70 years.

Embodiment 441. The method of treating or preventing a disorder of Embodiment 439, wherein the human subject is a newborn or infant, preferably of an age of not more than 3 years, of not more than 2 years, of not more than 1.5 years, of not more than 1 year (12 months), of not more than 9 months, 6 months or 3 months, or of an age between 6 months and 2 years.

Embodiment 442. The method of treating or preventing a disorder of Embodiment 439, wherein the human subject is 18 to 60 years of age.

Embodiment 443. The method of treating or preventing a disorder of Embodiment 439, wherein the human subject is less than 65, 60, 55, 50, 45 or 40 years of age.

Embodiment 444. The method of treating or preventing a disorder of Embodiment 443, wherein the human subject is between about 12 and 65; 12 and 60; 12 and 55; 12 and 50; 12 and 45; or 12 and 40 years of age.

Embodiment 445. The method of treating or preventing a disorder of Embodiment 439, wherein the human subject is between about 18 and 65, 18 to 60, 18 and 55; 18 and 50; 18 and 45; or 18 and 40 years of age.

Embodiment 446. The method of treating or preventing a disorder of Embodiment 439, wherein the human subject is between about 12 to 65; 12 and 60; 12 and 55; 12 and 50; 12 and 45; or 12 and 40 years of age.

Embodiment 447. The method of treating or preventing a disorder of Embodiment 439, wherein the human subject is between about 18 to 65; 18 and 60; 18 and 55; 18 and 50; 18 and 45; or 18 and 40 years of age.

Embodiment 448. The method of treating or preventing a disorder of Embodiment 439, wherein the human subject is between about 18 and 50 years of age.

Embodiment 449. The method of Embodiment 439, wherein the method reduces the severity of one or more symptom of COVID-19 disease.

Embodiment 450. The method of Embodiment 449, wherein the method reduces the probability that the subject will require hospital admission, intensive care unit admission, treatment with supplemental oxygen and/or treatment with a ventilator.

Embodiment 451. The method of Embodiment 449, wherein the method reduces the probability that the subject will develop severe or moderate COVID-19 disease.

Embodiment 452. The method of Embodiment 449, wherein the method prevents severe COVID-19 disease in the subject for at least about 6 months.

Embodiment 453. The method of Embodiment 449, wherein the method reduces the probability that the subject will develop a fever, breathing difficulties; loss of smell and/or loss of taste.

Embodiment 454. The method of any one of Embodiments 439 to 453, further defined as a method of stimulating an antibody, a CD4+ T cell response or a CD8+ T-cell response in the subject.

Embodiment 455. The method of any one of Embodiments 439 to 454, further defined as a method of stimulating a neutralizing antibody response in the subject.

Embodiment 456. The method of any one of Embodiments 439 to 455, wherein the subject is administered a composition that comprises between about 1 µg and about 50 µg of RNA; between about 2 µg and about 50 µg of RNA; between about 2 µg and about 25 µg of RNA; between about 5 µg and about 50 µg of RNA; between about 5 µg and about 25 µg of RNA; between about 10 µg and about 50 µg of RNA; between about 10 µg and about 30 µg of RNA; or about 12 µg of RNA.

Embodiment 457. The method of Embodiment 456, wherein the administration provides seroconversion in 100% of subjects to which the composition is administered.

Embodiment 458. The method of any one of Embodiments 439 to 457, wherein the subject was previously infected with SARS CoV-2.

Embodiment 459. The method of any one of Embodiments 439 to 457, wherein the subject was previously treated with at least a first SARS CoV-2 vaccine composition.

Embodiment 460. The method of Embodiment 459, wherein the first SARS CoV-2 vaccine composition was a mRNA vaccine.

Embodiment 461. The method of Embodiment 460, wherein the first SARS CoV-2 vaccine composition was BNT162, BNT162b2_B.1.1.529, BNT162b5, BNT162b2_BA.4/BA.5, mRNA-1273, mRNA-1273.211, mRNA-1273.214, mRNA-1273.222, and/or mRNA-1283.

Embodiment 462. The method of Embodiment 460, wherein the first SARS CoV-2 vaccine composition was a protein subunit vaccine.

Embodiment 463. The method of Embodiment 460, wherein the first SARS CoV-2 vaccine composition was an adenovirus vector vaccine.

Embodiment 464. The method of any one of Embodiments 439 to 459, wherein the subject has detectable SARS CoV-2 S protein-binding antibodies.

Embodiment 465. Use of RNA of any one of Embodiments 1 to 370 for the preparation or the manufacture of a medicament for treating or preventing a SARS-CoV-2 coronavirus infection or a disorder related to such an infection.

Embodiment 466. RNA comprising at least one coding sequence encoding at least one SARS-CoV-2 spike protein or an immunogenic fragment or immunogenic variant thereof, wherein the SARS-CoV-2 spike protein comprises at least one amino acid substitution, deletion or insertion, wherein the at least one amino acid substitution, deletion or insertion is located at a position selected from the group consisting of: N460, K444, T604, D574, K182, Y200, L518, E554, T572, Q675, D1153, E180, R21, V83, K97, H146, K147, N164, Q183, G184, N185, F186, P209, S256, G257, K356, L368, I410, P521, N658, I666, G798, T883, S1003, A1020, E1144, D1199 and C1243, relative to the sequence of SEQ ID NO: 1.

Embodiment 467. RNA comprising at least one coding sequence encoding at least one SARS-CoV-2 spike protein or an immunogenic fragment or immunogenic variant thereof, wherein the SARS-CoV-2 spike protein comprises at least one amino acid substitution selected from the group consisting of: N460K, K444M, K444R, K444T, V445P, E484R, F486P, K356T, D574V, T604I, Q52H, K147N, K182N, Y200C, T478Q, L518V, E554K, Q675H, T572I, D1153Y, E180V, P25S, V83A, H146Q, K147E, Q183E, I210V, L212S, V213E, D215H, H245N, G252V, G257D, G257S, G339H, L368I, N450D, F486S, F490V, N658S, G798D, S1003I, A1020S, D1199N, K97V, N164K, P209L, S256L, I666V, R21G, H146K, G184V, N185D, F186L, P521S, T883I, E1144Q, C1243F, D80Y, T547I and I410V relative to the sequence of SEQ ID NO: 1.

Embodiment 468. The RNA of Embodiment 466 or Embodiment 467, wherein the SARS-CoV-2 spike protein comprises at least one further amino acid substitution, deletion or insertion, wherein the at least one amino acid substitution, deletion or insertion is located at a position selected from the group consisting of: L5, L8, P9, S12, S13, L18, T19, T20, L24, P25, P26, A27, H49, Q52, A67, H69, V70, G75, T76, D80, T95, V126, C136, D138, L141, G142, V143, Y144, Y145, ins145, W152, M153, E154, E156, F157, R158, R190, I210, N211, L212, V213, R214, ins214, D215, A222, Q239, E241, L242, A243, L244, H245, R246, S247, Y248, L249, T250, P251, G252, D253, S254, W258, Q321, G339, V341, R346, A348, N354, R357, S359, V367, S371, S373, S375, T376, K378, P384, R403, D405, R408, Q409, Q414, K417, A435, N437, N439, N440, V445, G446, G447, Y449, N450, L452, Y453, L455, F456, K458, I472, A475, G476, S477, T478, V483, E484, G485, F486, N487, F490, Q493, S494, G496, Q498, P499, T500, N501, G502, V503, G504, Y505, Q506, Y508, H519, A522, T547, K558, A570, Q613, D614, H655, G669, Q677, N679, P681, R682, R683, A684, R685, I692, A701, T716, T732, T748, N764, G769, D796, A831, A845, N856, T859, F888, A899, D936, S939, S940, S943, Q949, D950, Q954, Q957, N969, L981, S982, T1027, V1040, Q1071, E1092, H1101, D1118, S1147, V1176, N1187, M1229, C1254, and P1263, relative to the sequence of SEQ ID NO: 1.

Embodiment 469. The RNA of any one of the preceding Embodiments, wherein the SARS-CoV-2 spike protein comprises at least one further amino acid substitution, deletion or insertion selected from the group consisting of: L5F, L8V, P9L, S12F, S13I, L18F, T19I, T19R, T20I, T20N, L24del, P25del, P26del, P26S, A27S, H49Y, Q52R, A67V, H69del, V70del, V70F, G75V, T76I, D80A, T95I, V126A, C136F, D138Y, L141del, G142D, G142del, V143del, Y144del, Y144S, Y144T, Y144F, Y145del, Y145H, Y145N, ins145N, Y145S, Y145D, W152C, W152L, W152R, M153T, E154K, E156G, F157del, F157L, R158del, R190S, I210T, N211del, L212del, L212I, V213G, R214A, ins214EPE, ins214TDR, D215G, A222V, Q239K, E241del, L242del, A243del, L244del, H245Y, R246del, R246I, S247del, Y248del, L249del, T250del, P251del, G252del, D253G, D253N, S254F, W258L, Q321L, Q321S, G339D, V341I, R346K, R346S, R346T, A348T, N354D, R357K, S359N, V367F, S371F, S371L, S373P, S375F, T376A, K378R, K378S, P384L, R403K, D405N, R408I, R408S, Q409E, Q414K, K417N, K417T, A435S, N437S, N439K, N440K, V445A, V445F, V445I, G446A, G446S, G446V, G447V, Y449H, N450K, L452M, L452Q, L452R, Y453F, L455F, F456A, F456K, F456L, F456V, K458R, K458R, I472V, A475S, A475V, G476A, G476S, S477G, S477I, S477N, S477R, S477T, T478A, T478I, T478K, T478R, V483A, E484A, E484D, E484K, E484P, E484Q, G485R, G485S, F486I, F486L, F486V, N487I, F490L, F490S, F490Y, Q493K, Q493L, Q493R, S494A, S494L, S494P, G496S, Q498R, P499H, P499L, P499S, T500I, N501S, N501T, N501Y, G502V, V503F, V503I, G504D, Y505H, Y505W, Q506H, Q506K, Y508H, H519P, A522S, T547K, K558N, A570D, Q613H, D614G, H655Y, G669S, Q677H, N679K, P681H, P681R, R682del, R683del, A684del, R685del, I692V, A701V, T716I, T732A, T748K, N764K, G769V, D796H, D796Y, A831V, A845S, N856K, T859N, F888L, A899S, D936N, S939F, S940F, S943P, Q949R, D950N, Q954H, Q957R, N969K, L981F, S982A, T1027I, V1040F, Q1071H, E1092K, H1101Y, D1118H, S1147L, V1176F, N1187D, M1229I, C1254F, and P1263L, relative to the sequence of SEQ ID NO: 1.

Embodiment 470. The RNA of Embodiment 469, wherein the SARS-CoV-2 spike protein comprises at least the amino acid substitutions and deletion corresponding to: T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486S, F490S, Q498R, N501Y, Y505H, D614G, H655Y, N679K, P681H, N764K, D796Y, Q954H, and N969K, relative to the sequence of SEQ ID NO: 1. 7 Embodiment 471. The RNA of Embodiment 469, wherein the SARS-CoV-2 spike protein comprises at least the amino acid substitutions and deletion corresponding to: T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, D614G, H655Y, N679K, P681H, N764K, D796Y, Q954H, and N969K, relative to the sequence of SEQ ID NO: 1.

Embodiment 472. The RNA of Embodiment 469, wherein the SARS-CoV-2 spike protein comprises at least the amino acid substitutions and deletion corresponding to: T19I, L24del, P25del, P26del, A27S, V83A, G142D, E180V, Y144del, H146Q, Q183E, V213E, G252V, G339H, R346T, L368I, S371F, S373P, S375F, T376A, D405N, R408S, K417N, N440K, V445P, G446S, N460K, S477N, T478R, E484A, F486P, F490S, Q498R, N501Y, Y505H, D614G, H655Y, N679K, P681H, N764K, D796Y, Q954H and N969K, relative to the sequence of SEQ ID NO: 1.

Embodiment 473. The RNA of Embodiment 469, wherein the SARS-CoV-2 spike protein comprises at least the amino acid substitutions and deletion corresponding to: T19I, L24del, P25del, P26del, A27S, V83A, G142D, Y144del, H146Q, Q183E, V213E, G252V, G339H, R346T, L368I, S371F, S373P, S375F, T376A, D405N, R408S, K417N, N440K, V445P, G446S, N460K, S477N, T478K, E484A, F486P, F490S, Q498R, N501Y, Y505H, Q613H, D614G, H655Y, N679K, P681H, N764K, D796Y, Q954H, and N969K, relative to the sequence of SEQ ID NO: 1.

Embodiment 474. The RNA of Embodiment 469, wherein the SARS-CoV-2 spike protein comprises at least the amino acid substitutions and deletion corresponding to: T19I, L24del, P25del, P26del, A27S, Q52H, V83A, G142D, Y144del, H146Q, Q183E, V213E, G252V, G339H, R346T, L368I, S371F, S373P, S375F, T376A, D405N, R408S, K417N, N440K, V445P, G446S, F456L, N460K, S477N, T478K, E484A, F486P, F490S, Q498R, N501Y, Y505H, D614G, H655Y, N679K, P681H, N764K, D796Y, Q954H and N969K.

Embodiment 475. The RNA of any one of the preceding Embodiments, wherein the spike protein (S) or the immunogenic fragment thereof comprises or consists of spike protein fragment S1 or RBD.

Embodiment 476. The RNA of any one of the preceding Embodiments, wherein the spike protein (S) is a pre-fusion stabilized spike protein (S_stab) comprising at least one pre-fusion stabilizing mutation comprising the amino acid substitutions: K986P and V987P, relative to the sequence of SEQ ID NO: 1.

Embodiment 477. The RNA of any one of the preceding Embodiments, wherein the at least one coding sequence is a codon modified coding sequence selected from the group consisting of C maximized coding sequence, CAI maximized coding sequence, human codon usage adapted coding sequence, G/C content modified coding sequence, G/C optimized coding sequence, and any combination thereof, and wherein the amino acid sequence encoded by the at least one codon modified coding sequence is not modified compared to the amino acid sequence encoded by the corresponding reference coding sequence.

Embodiment 478. The RNA of any one of the preceding Embodiments, wherein the RNA comprises at least one poly(A) sequence comprising 30 to 200 adenosine nucleotides, and/or at least one poly(C) sequence comprising 10 to 40 cytosine nucleotides, and/or at least one heterologous untranslated region (UTR) selected from at least one heterologous 5'-UTR and/or at least one heterologous 3'-UTR, wherein the least one heterologous 3'-UTR preferably comprises or consists of a nucleic acid sequence derived from a 3'-UTR of a gene selected from PSMB3, ALB7, CASP1, COX6B1, GNAS, NDUFA1 and RPS9, or from a homolog, a fragment or a variant of any one of these genes, and wherein the at least one heterologous 5'-UTR preferably comprises or consists of a nucleic acid sequence derived from a 5'-UTR of a gene selected from HSD17B4, RPL32, ASAH1, ATP5A1, MP68, NDUFA4, NOSIP, RPL31, SLC7A3, TUBB4B and UBQLN2, or from a homolog, a fragment or variant of any one of these genes.

Embodiment 479. The RNA of any one of the preceding Embodiments, wherein the RNA is an mRNA, a self-replicating RNA, a circular RNA, or a replicon RNA, preferably wherein the RNA comprises a 5'-cap structure, and wherein the RNA comprises a pseudouridine or 1-methylpseudouridine substitution.

Embodiment 480. A composition comprising the RNA according to any one of the preceding Embodiments and at least one pharmaceutically acceptable carrier, optionally wherein the composition is a multivalent composition comprising a plurality of RNAs comprising at least one further RNA in addition to the RNA as defined in any one of the preceding claims, wherein the RNA is encapsulated in a lipid-based carrier selected from the group consisting of liposomes, lipid nanoparticles (LNPs), lipoplexes, and nanoliposomes, and wherein said lipid nanoparticle (LNP) preferably comprises an ionizable cationic lipid, a phospholipid, a structural lipid, and an aggregation reducing lipid.

Embodiment 481. A vaccine comprising the RNA of any one of Embodiments 466 to 479, and/or the composition of Embodiment 480 and at least one adjuvant.

Embodiment 482. A Kit or kit of parts, comprising the RNA of any one of Embodiments 466 to 479, the composition of Embodiment 480, or the vaccine of Embodiment 481, a liquid vehicle for solubilising, and instructions providing information on administration and dosage of the components.

Embodiment 483. The RNA of any one of Embodiments 466 to 479, the composition of Embodiment 480, the vaccine of Embodiment 481, the kit or kit of parts of Embodiment 482, for use as a medicament or for use in the treatment or prophylaxis of an infection with a coronavirus.

Embodiment 484. A method of treating or preventing a disorder or disease in a subject in need thereof, wherein the method comprises applying or administering to the subject the RNA of any of Embodiments 466 to 479, the composition of Embodiment 480, the vaccine of Embodiment 481, or the kit or kit of parts of Embodiment 482, wherein the disorder or disease is an infection with a coronavirus, SARS-CoV-2 coronavirus, or wherein the disorder or disease is COVID-19.

Embodiment 485. The RNA of Embodiment 483, or the method of treating or preventing a disorder of Embodiment 484, wherein the coronavirus is a SARS-CoV-2 or COVID-19.

Embodiment 486. The RNA of any one of Embodiments 466 to 479, wherein the RNA encodes at least one SARS-CoV-2 spike protein comprising or consisting of at least one of amino acid sequence being identical or at least 70%, 80%, 85%, 86%, 87%, 88%, 89%, 90%, 91%, 92%, 93%, 94%, 95%, 96%, 97%, 98%, or 99% identical to SEQ ID NO:162.

EXAMPLES

The following examples illustrate various embodiments and aspects of the invention. The present invention is not intended to in any way be limited in scope by the specific embodiments described herein. The following preparations and examples are given to enable those skilled in the art to more clearly understand and to practice the present invention. The present invention, however, is not limited in scope by the exemplified embodiments, which are intended as illustrations of single aspects of the invention only, and methods, which are functionally equivalent are within the scope of the invention. Indeed, various modifications of the invention in addition to those described herein will become readily apparent to those skilled in the art from the foregoing description, accompanying figures and the examples below. All such modifications fall within the scope of the appended claims.

Example 1: Preparation of DNA and RNA Constructs, Compositions, and Vaccines

The present Example provides methods of obtaining the RNA of the invention as well as methods of generating a composition or a vaccine of the invention, which have also been described in international PCT patent application WO2022/137133.

Preparation of DNA and RNA constructs, RNA in vitro transcription and preparation of a LNP formulated mRNA composition, as well as methods of generating a vaccine of the invention are performed as previously disclosed in WO2022/137133.

The generated RNA sequences/constructs are provided in Table 3 with the encoded antigenic protein and the respective UTR elements indicated therein. If not indicated otherwise, the RNA sequences/constructs of Table 3 are produced using RNA in vitro transcription in the presence of a m7GpppG, m7G(5')ppp(5')(2'OMeA)pG; accordingly, the RNA sequences/constructs comprise a 5' Cap1 structure. If not indicated otherwise, the RNA sequences/constructs of Table 3 are produced in the presence of chemically modified nucleotides (e.g. N(1)-methylpseudouridine (m1ψ)).

TABLE 3

RNA constructs encoding different SARS-CoV-2 S antigen designs

| RNA ID | Name | SEQ ID NO: PRT | SEQ ID NO: CDS | SEQ ID NO: RNA |
|---|---|---|---|---|
| R11820 | S_stab_PP(K986P_V987P_T19I_L24del_P25del_P26del_A27S_V83A_G142D_Y144del_H146Q_Q183E_V213E_G252V_G339H_R346T_L368I_S371F_S373P_S375F_T376A_D405N_R408S_K417N_N440K_V445P_G446S_N460K_S477N_T478K_E484A_F486S_F490S_Q498R_N501Y_Y505H_D614G_H655Y_N679K_P681H_N764K_D796Y_Q954H_N969K); XBB.1 | 45 | 70 | 127 |
| | S_stab_PP_(K986P_V987P_T19I_L24del_P25del_P26del_A27S_V83A_G142D_Y144del_H146Q_Q183E_V213E_G339H_R346T_L368I_S371F_S373P_S375F_T376A_D405N_R408S_K417N_N440K_V445P_G446S_S477N_T478K_V483A_E484A_F490V_Q493R_Q498R_N501Y_Y505H_D614G_H655Y_N679K_P681H_N764K_D796Y_G798D_Q954H_N969K_S1003I); BJ.1 | 46 | 71 | 128 |
| R11805 | S_stab_PP(K986P_V987P_T19I_L24del_P25del_P26del_A27S_H69del_V70del_G142D_V213G_G339D_R346T_S371F_S373P_S375F_T376A_D405N_R408S_K417N_N440K_K444T_L452R_N460K_S477N_T478K_E484A_F486V_Q498R_N501Y_Y505H_D614G_H655Y_N679K_P681H_N764K_D796Y_Q954H_N969K); BQ.1.1 | 47 | 72 | 129 |
| | S_stab_PP(K986P_V987P_T19I_L24del_P25del_P26del_A27S_H69del_V70del_G142D_V213G_G339D_S371F_S373P_S375F_T376A_D405N_R408S_K417N_N440K_K444T_L452R_N460K_S477N_T478K_E484A_F486V_Q498R_N501Y_Y505H_D614G_H655Y_I666V_N679K_P681H_N764K_D796Y_Q954H_N969K); BQ.1.2 | | | |
| | S_stab_PP(K986P_V987P_T19I_L24del_P25del_P26del_A27S_H69del_V70del_G142D_Y144del_V213G_G339D_S371F_S373P_S375F_T376A_D405N_R408S_K417N_N440K_K444M_L452R_N460K_S477N_T478K_E484A_F486V_Q498R_N501Y_Y505H_D614G_H655Y_N679K_P681H_N764K_D796Y_Q954H_N969K); BU.1 | 48 | 73 | 130 |
| | S_stab_PP(K986P_V987P_T19I_L24del_P25del_P26del_A27S_H69del_V70del_G142D_V213G_G339D_S371F_S373P_S375F_T376A_D405N_R408S_K417N_N440K_L452R_S477N_T478K_E484A_F486V_Q498R_N501Y_Y505H_D614G_H655Y_N679K_P681H_N764K_D796Y_Q954H_N969K_A1020S); BF.5 | 49 | 74 | 131 |
| R11803 | S_stab_PP(K986P_V987P_T19I_L24del_P25del_P26del_A27S_G142D_K147E_W152R_F157L_I210V_V213G_G257S_G339H_S371F_S373P_S375F_T376A_D405N_R408S_K417N_N440K_G446S_N460K_S477N_T478K_E484A_Q498R_N501Y_Y505H_D614G_H655Y_N679K_P681H_N764K_D796Y_Q954H_N969K); BA.2.75 | 50 | 75 | 132 |
| R11804 | S_stab_PP(K986P_V987P_T19I_L24del_P25del_P26del_A27S_G142D_K147E_W152R_F157L_I210V_V213G_G257S_G339H_S371F_S373P_S375F_T376A_D405N_R408S_K417N_N440K_G446S_N460K_S477N_T478K_E484A_Q498R_N501Y_Y505H_D574V_D614G_H655Y_N679K_P681H_N764K_D796Y_Q954H_N969K); BA.2.75.1 | 51 | 76 | 133 |
| R11802 | S_stab_PP(K986P_V987P_T19I_L24del_P25del_P26del_A27S_G142D_K147E_W152R_F157L_I210V_V213G_G257S_G339H_R346T_S371F_S373P_S375F_T376A_D405N_R408S_K417N_N440K_G446S_N460K_S477N_T478K_E484A_F486S_Q498R_N501Y_Y505H_D614G_H655Y_N679K_P681H_N764K_D796Y_Q954H_N969K_D1199N); BA.2.75.2 | 52 | 77 | 134 |
| | S_stab_PP(K986P_V987P_T19I_L24del_P25del_P26del_A27S_G142D_K147E_W152R_F157L_I210V_V213G_G257S_G339H_R346T_S371F_S373P_S375F_ | 53 | 78 | 135 |

TABLE 3-continued

RNA constructs encoding different SARS-CoV-2 S antigen designs

| RNA ID | Name | SEQ ID NO: PRT | SEQ ID NO: CDS | SEQ ID NO: RNA |
|---|---|---|---|---|
| | T376A_D405N_R408S_K417N_N440K_G446S_L452R_N460K_S477N_T478K_E484A_F486S_Q498R_N501Y_Y505H_T604I_D614G_H655Y_N679K_P681H_N764K_D796Y_Q954H_N969K_D1199N); CA.1 | | | |
| | S_stab_PP(K986P_V987P_T19I_L24del_P25del_P26del_A27S_G142D_K147E_W152R_F157L_I210V_V213G_G257S_G339H_R346T_S371F_S373P_S375F_T376A_D405N_R408S_K417N_N440K_G446S_N460K_S477N_T478K_E484A_F486S_Q498R_N501Y_Y505H_D614G_H655Y_N679K_P681H_N764K_D796Y_Q954H_N969K); BM1.1 | 54 | 79 | 136 |
| | S_stab_PP(K986P_V987P_T19I_L24del_P25del_P26del_A27S_G142D_K147E_W152R_F157L_I210V_V213G_G257S_G339H_R346T_S371F_S373P_S375F_T376A_D405N_R408S_K417N_N440K_G446S_N460K_S477N_T478K_E484A_F486S_F490S_Q498R_N501Y_Y505H_D614G_H655Y_N679K_P681H_N764K_D796Y_Q954H_N969K); BM.1.1.1 | 55 | 80 | 137 |
| R10821 | S_stab_PP(K986P_V987P); ancestral Wuhan | 2 | 82 | 139 |
| R10813 | S_stab_PP(K986P_V987P_D614G); D614G | 56 | 83 | 140 |
| | S_stab_PP(K986P_V987P_K444T_N460K) | | | |
| | S_stab_PP(K986P_V987P_K444M_N460K) | | | |
| | S_stab_PP(K986P_V987P_V83A_H146Q_Q183E_V213E_G252V_G339H_L368I_V445P_N460K_F486S) | | | |
| | S_stab_PP(K986P_V987P_N460K_F486S) | | | |
| | S_stab_PP(K986P_V987P_R346T_N460K_F490S) | | | |
| | S_stab_PP(K986P_V987P_Y144del_R346T_N460K_F490S) | | | |
| | S_stab_PP(K986P_V987P_N460K) | | | |
| | S_stab_PP(K986P_V987P_L452R_N460K) | | | |
| | S_stab_PP(K986P_V987P_R346T_K444T_N460K) | | | |
| | S_stab_PP(K986P_V987P_Y144del_K444M_N460K) | | | |
| | S_stab_PP(K986P_V987P_Y144del_G252V_N460K) | | | |
| | S_stab_PP(K986P_V987P_G339H_R346T) | | | |
| | S_stab_PP(K986P_V987P_R346T_F486S) | | | |
| | S_stab_PP(K986P_V987P_R346T_F486S_D1199N) | | | |
| | S_stab_PP(K986P_V987P_R346T_N658S) | | | |
| | S_stab_PP(K986P_V987P_L452R_T604I) | | | |
| | S_stab_PP(K986P_V987P_K444M_A1020S) | | | |
| | S_stab_PP(K986P_V987P_V83A_H146Q_Q183E_V213E_G252V_G339H_L368I_V445P_N460K_F486S_F490S) | | | |
| | S_stab_PP(K986P_V987P_V83A) | | | |
| | S_stab_PP(K986P_V987P_H146Q) | | | |
| | S_stab_PP(K986P_V987P_K147E) | | | |
| | S_stab_PP(K986P_V987P_Q183E) | | | |
| | S_stab_PP(K986P_V987P_I210V) | | | |
| | S_stab_PP(K986P_V987P_V213E) | | | |
| | S_stab_PP(K986P_V987P_G252V) | | | |
| | S_stab_PP(K986P_V987P_G257S) | | | |
| | S_stab_PP(K986P_V987P_G339H) | | | |
| | S_stab_PP(K986P_V987P_L368I) | | | |
| | S_stab_PP(K986P_V987P_K444M) | | | |
| | S_stab_PP(K986P_V987P_K444T) | | | |
| | S_stab_PP(K986P_V987P_V445P) | | | |
| | S_stab_PP(K986P_V987P_F486S) | | | |
| | S_stab_PP(K986P_V987P_F490V) | | | |
| | S_stab_PP(K986P_V987P_D574V) | | | |
| | S_stab_PP(K986P_V987P_T604I) | | | |
| | S_stab_PP(K986P_V987P_N658S) | | | |
| | S_stab_PP(K986P_V987P_G798D) | | | |
| | S_stab_PP(K986P_V987P_S1003I) | | | |
| | S_stab_PP(K986P_V987P_A1020S) | | | |
| | S_stab_PP(K986P_V987P_D1199N) | | | |
| | S_stab_PP(K986P_V987P_K444T_N460K_D614G) | | | |
| | S_stab_PP(K986P_V987P_K444M_N460K_D614G) | | | |
| | S_stab_PP(K986P_V987P_V83A_H146Q_Q183E_V213E_G252V_G339H_L368I_V445P_N460K_F486S_D614G) | | | |
| | S_stab_PP(K986P_V987P_N460K_F490S_D614G) | | | |
| | S_stab_PP(K986P_V987P_R346T_N460K_F490S_D614G) | | | |
| | S_stab_PP(K986P_V987P_Y144del_R346T_N460K_F490S_D614G) | | | |
| | S_stab_PP(K986P_V987P_N460K_D614G) | | | |
| | S_stab_PP(K986P_V987P_L452R_N460K_D614G) | | | |
| | S_stab_PP(K986P_V987P_R346T_K444T_N460K_D614G) | | | |
| | S_stab_PP(K986P_V987P_Y144del_K444M_N460K_D614G) | | | |
| | S_stab_PP(K986P_V987P_Y144del_G252V_N460K_D614G) | | | |
| | S_stab_PP(K986P_V987P_G339H_R346T_D614G) | | | |
| | S_stab_PP(K986P_V987P_R346T_F486S_D614G) | | | |
| | S_stab_PP(K986P_V987P_R346T_F486S_D614G_D1199N) | | | |
| | S_stab_PP(K986P_V987P_R346T_D614G_N658S) | | | |
| | S_stab_PP(K986P_V987P_L452R_T604I_D614G) | | | |
| | S_stab_PP(K986P_V987P_K444M_D614G_A1020S) | | | |

TABLE 3-continued

RNA constructs encoding different SARS-CoV-2 S antigen designs

| RNA ID | Name | SEQ ID NO: PRT | SEQ ID NO: CDS | SEQ ID NO: RNA |
|---|---|---|---|---|
| | S_stab_PP(K986P_V987P_V83A_H146Q_Q183E_V213E_G252V_G339H_L368I_V445P_N460K_F486S_F490S_D614G) | | | |
| | S_stab_PP(K986P_V987P_V83A_D614G) | | | |
| | S_stab_PP(K986P_V987P_H146Q_D614G) | | | |
| | S_stab_PP(K986P_V987P_K147E_D614G) | | | |
| | S_stab_PP(K986P_V987P_Q183E_D614G) | | | |
| | S_stab_PP(K986P_V987P_I210V_D614G) | | | |
| | S_stab_PP(K986P_V987P_V213E_D614G) | | | |
| | S_stab_PP(K986P_V987P_G252V_D614G) | | | |
| | S_stab_PP(K986P_V987P_G257S_D614G) | | | |
| | S_stab_PP(K986P_V987P_G339H_D614G) | | | |
| | S_stab_PP(K986P_V987P_L368I_D614G) | | | |
| | S_stab_PP(K986P_V987P_K444M_D614G) | | | |
| | S_stab_PP(K986P_V987P_K444T_D614G) | | | |
| | S_stab_PP(K986P_V987P_V445P_D614G) | | | |
| | S_stab_PP(K986P_V987P_F486S_D614G) | | | |
| | S_stab_PP(K986P_V987P_F490V_D614G) | | | |
| | S_stab_PP(K986P_V987P_D574V_D614G) | | | |
| | S_stab_PP(K986P_V987P_T604I_D614G) | | | |
| | S_stab_PP(K986P_V987P_N658S_D614G) | | | |
| | S_stab_PP(K986P_V987P_G798D_D614G) | | | |
| | S_stab_PP(K986P_V987P_S1003I_D614G) | | | |
| | S_stab_PP(K986P_V987P_A1020S_D614G) | | | |
| | S_stab_PP(K986P_V987P_D1199N_D614G) | | | |
| | S_stab_PP(K986P_V987P_T19I_L24del_P25del_P26del_A27S_G142D_K147E_W152R_F157L_I210V_V213G_G257S_G339H_R346T_K356T_S371F_S373P_S375F_T376A_D405N_R408S_K417N_N440K_G446S_N460K_S477N_T478K_E484A_F490S_Q498R_N501Y_Y505H_D614G_H655Y_N679K_P681H_N764K_D796Y_Q954H_N969K); BN.1 | 159 | 165 | 177 |
| | S_stab_PP(K986P_V987P_T19I_L24del_P25del_P26del_A27S_G142D_K147E_W152R_F157L_I210V_V213G_G257S_G339H_R346T_S371F_S373P_S375F_T376A_D405N_R408S_K417N_N440K_G446S_N460K_S477N_T478K_E484A_F486P_F490S_Q498R_N501Y_Y505H_D614G_H655Y_N679K_P681H_N764K_D796Y_Q954H_N969K); XBF | 160 | 166 | 178 |
| | S_stab_PP(K986P_V987P_T19I_L24del_P25del_P26del_A27S_G142D_M153T_N164K_V213G_H245N_G257D_G339H_S371F_S373P_S375F_T376A_D405N_R408S_K417N_N440K_K444R_N450D_L452M_N460K_S477N_T478K_E484A_Q498R_N501Y_Y505H_D614G_H655Y_N679K_P681H_N764K_D796Y_Q954H_N969K); CM.2 | 161 | 167 | 179 |
| R12018 | S_stab_PP(K986P_V987P_T19I_L24del_P25del_P26del_A27S_V83A_G142D_Y144del_H146Q_Q183E_V213E_G252V_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_D614G_H655Y_N679K_P681H_N764K_D796Y_Q954H_N969K); XBB.1.5 | 162 | 168 | 180 |
| | S_stab_PP(K986P_V987P_T19I_P25S_G142D_Y144del_E156G_F157del_R158del_P209L_L212S_D215H_A222V_A243del_L244del_S371F_S373P_S375F_T376A_D405N_R408S_K417N_N440K_G446S_L452M_S477N_T478K_E484A_F486P_Q498R_N501Y_Y505H_D614G_H655Y_N679K_P681H_N703I_N764K_D796Y_Q954H_N969K); XBC.1 | 163 | 169 | 181 |
| | S_stab_PP(K986P_V987P_T19I_P25S_K97R_G142D_Y144del_E156G_F157del_R158del_P209L_L212S_D215H_A222V_A243del_L244del_S371F_S373P_S375F_T376A_D405N_R408S_K417N_N440K_G446S_S477N_T478K_E484A_F486P_Q498R_N501Y_Y505H_D614G_H655Y_N679K_P681H_N703I_N764K_D796Y_Q954H_N969K); XBC.2 | 164 | 170 | 182 |
| | S_stab_PP(K986P_V987P_F486P) | | | |
| | S_stab_PP(K986P_V987P_F486P_N460K) | | | |
| | S_stab_PP(K986P_V987P_R346T_F486P_N460K) | | | |
| | S_stab_PP(K986P_V987P_Y144del_F486P_N460K) | | | |
| | S_stab_PP(K986P_V987P_F490S_F486P_N460K) | | | |
| | S_stab_PP(K986P_V987P_F486P_D614G) | | | |
| | S_stab_PP(K986P_V987P_T19I_L24del_P25del_P26del_A27S_H69del_V70del_G142D_Y144del_V213G_G339D_R346T_S371F_S373P_T376A_D405N_R408S_K417N_N440K_K444T_L452R_N460K_S477N_T478K_E484A_F486V_Q498R_N501Y_Y505H_D614G_H655Y_N679K_P681H_N764K_D796Y_Q954H_N969K); BQ.1.18 | 183 | 202 | 240 |
| R12309 | S_stab_PP(K986P_V987P_T19I_L24del_P25del_P26del_A27S_V83A_G142D_E180V_Y144del_H146Q_Q183E_V213E_G252V_G339H_R346T_L368I_S371F_S373P_S375F_T376A_D405N_R408S_K417N_N440K_V445P_G446S_N460K_S477N_T478R_E484A_F486P_F490S_Q498R_N501Y_Y505H_D614G_H655Y_N679K_P681H_N764K_D796Y_Q954H_N969K); XBB.1.16 | 184 | 203 | 241 |
| R12320 | S_stab_PP(K986P_V987P_T19I_L24del_P25del_P26del_A27S_V83A_G142D_E180V_Y144del_H146Q_Q183E_V213E_G252V_G339H_R346T_L368I_S371F_S373P_S375F_T376A_D405N_R408S_K417N_N440K_V445P_G446S_N460K_S477N_T478R_E484A_F486P_F490S_Q498R_N501Y_Y505H_T547I_D614G_H655Y_N679K_P681H_N764K_D796Y_Q954H_N969K); XBB.1.16.1 | 185 | 204 | 242 |

TABLE 3-continued

RNA constructs encoding different SARS-CoV-2 S antigen designs

| RNA ID | Name | SEQ ID NO: PRT | SEQ ID NO: CDS | SEQ ID NO: RNA |
|---|---|---|---|---|
| | S_stab_PP(K986P_V987P_T19I_L24del_P25del_P26del_A27S_V83A_G142D_Y144del_H146Q_Q183E_D215H_V213E_G252V_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_D614G_H655Y_N679K_P681H_N764K_D796Y_Q954H_N969K); XBB.1.17.1 | 186 | 205 | 243 |
| | S_stab_PP(K986P_V987P_T19I_L24del_P25del_P26del_A27S_V83A_G142D_Y144del_H146Q_Q183E_V213E_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_D614G_H655Y_N679K_P681H_N764K_D796Y_Q954H_N969K); XBB.1.22 | 187 | 206 | 244 |
| | S_stab_PP(K986P_V987P_T19I_L24del_P25del_P26del_A27S_V83A_G142D_Y144del_H146Q_Q183E_V213E_D253G_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_P521S_D614G_H655Y_N679K_P681H_N764K_D796Y_Q954H_N969K); XBB.2.3 | 188 | 207 | 245 |
| | S_stab_PP(K986P_V987P_T19I_L24del_P25del_P26del_A27S_D80Y_V83A_G142D_Y144del_H146Q_Q183E_V213E_D253G_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_P521S_D614G_H655Y_N679K_P681H_N764K_D796Y_Q954H_N969K); XBB.2.3.1 | 189 | 208 | 246 |
| | S_stab_PP(K986P_V987P_T19I_L24del_P25del_P26del_A27S_V83A_G142D_Y144del_H146Q_Q183E_G184V_V213E_D253G_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_P521S_D614G_H655Y_N679K_P681H_N764K_D796Y_Q954H_N969K); XBB.2.3.2 | 190 | 209 | 247 |
| | S_stab_PP(K986P_V987P_L18F_T19R_R21G_T95I_W152L_E156G_F157del_R158del_F186L_V213G_G339D_S371F_S373P_S375F_T376A_D405N_R408S_K417N_N440K_G446D_S477N_L452R_T478K_E484A_F486P_Q498R_N501Y_Y505H_D614G_P621S_H655Y_N679K_P681H_A706V_N764K_D796Y_Q954H_N969K_T1117I); XAY.2 | 191 | 210 | 248 |
| | S_stab_PP(K986P_V987P_T19I_L24del_P25del_P26del_A27S_V83A_G142D_Y144del_H146Q_Q183E_V213E_G252V_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_D614G_H655Y_N679K_P681H_N764K_D796Y_Q954H_N969K); FD.2 | 192 | 211 | 249 |
| R11806 | S_stab_PP(K986P_V987P_T19I_L24del_P25del_P26del_A27S_H69del_V70del_G142D_V213G_G339D_R346T_S371F_S373P_S375F_T376A_D405N_R408S_K417N_N440K_L452R_S477N_T478K_E484A_F486V_Q498R_N501Y_Y505H_D614G_H655Y_N679K_P681H_N764K_D796Y_Q954H_N969K); BF.7 | 193 | 212 | 250 |
| | S_stab_PP(K986P_V987P_T19I_L24del_P25del_P26del_A27S_H69del_V70del_G142D_V213G_G339D_R346T_S371F_S373P_S375F_T376A_D405N_R408S_K417N_N440K_L452R_S477N_T478K_E484A_F486V_Q498R_N501Y_Y505H_D614G_H655Y_N679K_P681H_N764K_D796Y_Q954H_N969K_C1243F); BF.7.14 | 194 | 213 | 251 |
| R12036 | S_stab_PP(K986P_V987P_T19I_L24del_P25del_P26del_A27S_G142D_K147E_W152R_F157L_I210V_V213G_G257S_G339H_R346T_S371F_S373P_S375F_T376A_D405N_R408S_K417N_N440K_K444T_G446S_N460K_L452R_S477N_T478K_E484A_F486S_Q498R_N501Y_Y505H_D614G_H655Y_N679K_P681H_N764K_D796Y_Q954H_N969K); CH.1.1 | 195 | 214 | 252 |
| | S_stab_PP(K986P_V987P_T19I_L24del_P25del_P26del_A27S_G142D_K147E_W152R_F157L_N185D_I210V_V213G_G257S_G339H_R346T_S371F_S373P_S375F_T376A_D405N_R408S_K417N_N440K_K444T_G446S_N460K_L452R_S477N_T478K_E484A_F486S_Q493R_Q498R_N501Y_Y505H_D614G_H655Y_N679K_P681H_N764K_D796Y_Q954H_N969K); CH.1.1.1 | 196 | 215 | 253 |
| | S_stab_PP(K986P_V987P_T19I_L24del_P25del_P26del_A27S_G142D_K147E_W152R_F157L_I210V_V213G_G257S_G339H_R346T_S371F_S373P_S375F_T376A_D405N_R408S_K417N_N440K_K444T_G446S_N460K_L452R_S477N_T478K_E484A_F486S_Q493R_Q498R_N501Y_Y505H_D614G_H655Y_N679K_P681H_N764K_D796Y_T883I_Q954H_N969K); CH.1.1.2 | 197 | 216 | 254 |
| | S_stab_PP(K986P_V987P_T19I_L24del_P25del_P26del_A27S_H69del_V70del_G142D_Y144del_V213G_D253G_G339D_R346T_S371F_S373P_S375F_T376A_D405N_R408S_K417N_N440K_K444T_L452R_N460K_S477N_T478K_E484A_F486V_Q498R_N501Y_Y505H_D614G_H655Y_N679K_P681H_N764K_D796Y_Q954H_N969K); DU.1 | 198 | 217 | 255 |
| | S_stab_PP(K986P_V987P_T19I_L24del_P25del_P26del_A27S_V83A_G142D_Y144del_H146Q_Q183E_V213E_G252V_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_Q613H_D614G_H655Y_N679K_P681H_N764K_D796Y_Q954H_N969K); EG.1 | 199 | 218 | 256 |
| | S_stab_PP(K986P_V987P_T19I_P25S_G142D_Y144del_E156G_F157del_R158del_P209L_L212S_D215H_A222V_A243del_L244del_S256L_R346S_S371F_S373P_S375F_T376A_D405N_R408S_K417N_N440K_G446S_L452R_S477N_T478K_E484A_F486P_Q498R_N501Y_Y505H_D614G_H655Y_N679K_P681H_N703I_N764K_D796Y_Q954H_N969K); XBC.1.6 | 200 | 219 | 257 |

TABLE 3-continued

RNA constructs encoding different SARS-CoV-2 S antigen designs

| RNA ID | Name | SEQ ID NO: PRT | SEQ ID NO: CDS | SEQ ID NO: RNA |
|---|---|---|---|---|
| | S_stab_PP(K986P_V987P_T19I_L24del_P25del_P26del_A27S_V83A_G142D_Y144del_H146Q_Q183E_V213E_G252V_G339H_R346T_L368I_S371F_S373P_S375F_T376A_D405N_R408S_I410V_K417N_N440K_V445P_G446S_N460K_S477N_T478K_E484A_F486P_F490S_Q498R_N501Y_Y505H_P521S_D614G_H655Y_N679K_P681H_N764K_D796Y_Q954H_N969K); EU.1.1 | 201 | 220 | 258 |
| | S_stab_PP(K986P_V987P_T19I_L24del_P25del_P26del_A27S_G142D_K147E_W152R_F157L_I210V_V213G_D215G_G257S_G339H_R346T_S371F_S373P_S375F_T376A_D405N_R408S_K417N_N440K_K444T_G446S_N460K_L452R_S477N_T478K_E484A_F486P_Q498R_N501Y_Y505H_Q613H_D614G_H655Y_N679K_P681H_N764K_D796Y_Q954H_N969K); FK.1 | | | |
| | S_stab_PP(K986P_V987P_T19I_L24del_P25del_P26del_A27S_Q52H_V83A_G142D_Y144del_H146Q_Q183E_V213E_G252V_G339H_R346T_L368I_S371F_S373P_S375F_T376A_D405N_R408S_K417N_N440K_V445P_G446S_F456L_N460K_S477N_T478K_E484A_F486P_F490S_Q498R_N501Y_Y505H_D614G_H655Y_N679K_P681H_N764K_D796Y_Q954H_N969K); EG.5.1 | 264 | 277 | 303 |
| | S_stab_PP(K986P_V987P_T19I_L24del_P25del_P26del_A27S_V83A_G142D_Y144del_H146Q_Q183E_V213E_G252V_G339H_R346T_L368I_S371F_S373P_S375F_T376A_D405N_R408S_K417N_N440K_V445P_G446S_F456L_N460K_S477N_T478K_E484A_F486P_F490S_Q498R_N501Y_Y505H_D614G_H655Y_N679K_P681H_N764K_D796Y_Q954H_N969K); EG.5 (FE.1/XBB.1.18.1.1) | 265 | 278 | 304 |
| | S_stab_PP(K986P_V987P_T19I_L24del_P25del_P26del_A27S_V83A_G142D_Y144del_H146Q_K182G_Q183E_V213E_D253G_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_P521S_D614G_H655Y_N679K_P681H_N764K_D796Y_Q954H_N969K); XBB.2.3.3 | 266 | 279 | 305 |
| | S_stab_PP(K986P_V987P_T19I_L24del_P25del_P26del_A27S_V83A_G142D_Y144del_H146Q_Q183E_V213E_D253G_G339H_R346T_L368I_S371F_S373P_S375F_T376A_D405N_R408S_K417N_N440K_V445P_G446S_N460K_S477N_T478Q_E484A_F486P_F490S_Q498R_N501Y_Y505H_P521S_D614G_H655Y_N679K_P681H_N764K_D796Y_Q954H_N969K); XBB.2.4 | 267 | 280 | 306 |
| | S_stab_PP(K986P_V987P_T19I_L24del_P25del_P26del_A27S_V83A_G142D_Y144del_H146Q_Q183E_V213E_G252V_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_L518V_D614G_H655Y_N679K_P681H_N764K_D796Y_Q954H_N969K); GB.1 | 268 | 281 | 307 |
| | S_stab_PP(K986P_V987P_T19I_L24del_P25del_P26del_A27S_V83A_G142D_Y144del_H146Q_Q183E_V213E_G252V_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_D614G_H655Y_N679K_P681H_A701V_N764K_D796Y_Q954H_N969K); FL.1 (FL.1.3) | 269 | 282 | 308 |
| | S_stab_PP(K986P_V987P_T19I_L24del_P25del_P26del_A27S_G142D_K147N_M153T_N164K_V213G_H245N_G257D_G339D_R346T_S371F_S373P_S375F_T376A_D405N_R408S_K417N_N440K_K444R_G446S_N450D_L452M_N460K_S477N_T478K_E484R_F486S_Q498R_N501Y_Y505H_D614G_H655Y_N679K_P681H_N764K_D796Y_Q954H_N969K); FV.1 | 270 | 283 | 309 |
| | S_stab_PP(K986P_V987P_T19I_L24del_P25del_P26del_A27S_V83A_G142D_Y144del_H146Q_E180V_Q183E_V213E_G252V_G339H_R346T_L368I_S371F_S373P_S375F_T376A_D405N_R408S_K417N_N440K_V445P_G446S_F456L_N460K_S477N_T478K_E484A_F486P_F490S_Q498R_N501Y_Y505H_D614G_H655Y_N679K_P681H_N764K_D796Y_Q954H_N969K); XBB.1.16.6 | 271 | 284 | 310 |
| | S_stab_PP(K986P_V987P_T19I_L24del_P25del_P26del_A27S_V83A_G142D_Y144del_H146Q_Q183E_V213E_G252V_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_E554K_D614G_H655Y_N679K_P681H_N764K_D796Y_Q954H_N969K); XBB.1.19.1 | 272 | 285 | 311 |
| | S_stab_PP(K986P_V987P_T19I_L24del_P25del_P26del_A27S_V83A_G142D_Y144del_H146Q_Q183E_Y200C_V213E_G252V_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_D614G_H655Y_N679K_P681H_N764K_D796Y_Q954H_N969K); XBB.1.22.1 | 273 | 286 | 312 |
| | S_stab_PP(K986P_V987P_T19I_L24del_P25del_P26del_A27S_V83A_G142D_Y144del_H146Q_Q183E_V213E_G252V_G339H_R346T_L368I_S371F_S373P_S375F_T376A_D405N_R408S_K417N_N440K_V445P_G446S_N460K_S477N_T478K_E484A_F486P_F490S_Q498R_N501Y_Y505H_D614G_H655Y_Q675H_N679K_P681H_N764K_D796Y_Q954H_N969K); EL.1 | 274 | 287 | 313 |
| | S_stab_PP(K986P_V987P_L18F_T19R_R21G_T95I_G142D_W152R_E156G_F157del_R158del_F186L_V213D_D253G_G339H_R346T_S371F_S373P_S375F_T376A_D405N_R408S_K417N_N440K_G446D_L452R_S477N_T478K_E484A_F486P_Q498R_N501Y_Y505H_D614G_P621S_H655Y_N679K_P681H_A706V_N764K_D796Y_Q954H_N969K_T1117I_D1153Y); XAY.1.1.1 | 275 | 288 | 314 |

TABLE 3-continued

RNA constructs encoding different SARS-CoV-2 S antigen designs

| RNA ID | Name | SEQ ID NO: PRT | SEQ ID NO: CDS | SEQ ID NO: RNA |
|---|---|---|---|---|
| | S_stab_PP(K986P_V987P_T19I_L24del_P25del_P26del_A27S_V83A_G142D_Y144del_H146Q_Q183E_V213E_G252V_G339H_R346T_K356T_L368I_S371F_S373P_S375F_T376A_D405N_R408S_K417N_N440K_V445P_G446S_N460K_S477N_T478K_E484A_F486P_F490S_Q498R_N501Y_Y505H_T572I_D614G_H655Y_N679K_P681H_N764K_D796Y_Q954H_N969K); XBB.1.5.44 | 276 | 289 | 315 |

The mRNA constructs as shown in Table 3 are tested for their expression in cell culture using western blot or FACS as commonly known in the art.

Example 2: Vaccination of Mice or Rats with mRNA Encoding a SARS-Cov-2 Spike Protein According to the Invention This study was designed to determine if vaccinations with mRNA vaccines encoding SARS-CoV-2 variants induce immunogenicity with cross-neutralizing capacity.

Preparation and purification of LNP formulated mRNA vaccines are performed as described in in Example 1.

Immunization:

Female BALB/c mice (6-8 weeks old) or rats are injected intramuscularly (i.m.) with mRNA vaccine compositions. As a negative control, one group of mice is vaccinated with buffer. All animals are vaccinated on day 0 and 21. Blood samples were collected on day 14, day 21 and day 42 for the determination of humoral immune responses.

Determination of IgG1 and IgG2 Spike-Binding Antibody Titers Using ELISA:

Anti-SARS-CoV-2 Spike RBD protein specific binding antibodies, displayed as endpoint titers for IgG1 and IgG2a, is determined in isolated sera. Recombinant SARS-CoV-2 Spike RBD protein or recombinant SARS-CoV-2 Spike protein of variants is used for coating. Coated plates are incubated using respective serum dilutions, and binding of specific antibodies to RBD or spike protein is detected with a biotinylated antibody.

Intracellular Cytokine Staining:

Splenocytes from vaccinated mice are isolated according to a standard protocol known in the art. Briefly, isolated spleens are grinded through a cell strainer and washed in PBS/1% FBS followed by red blood cell lysis. After an extensive washing step with PBS/1% FBS, splenocytes are seeded into 96-well plates ($2\times10^6$ cells per well). Cells are stimulated with a mixture of 2019-nCoV protein specific peptide epitopes (5 µg/ml of each peptide) in the presence of 2.5 µg/ml of an anti-CD28 antibody (BD Biosciences) for 6 hours at 37° C. in the presence of a protein transport inhibitor. After stimulation, cells are washed and stained for intracellular cytokines using the Cytofix/Cytoperm reagent (BD Biosciences) according to the manufacturer's instructions. The following antibodies are used for staining: Thy1.2-FITC (1:200), CD8-APC-H7 (1:100), TNF-PE (1:100), IFNγ-APC (1:100) (eBioscience), CD4-BD Horizon V450 (1:200) (BD Biosciences) and incubated with Fcγ-block diluted 1:100. Aqua Dye is used to distinguish live/dead cells (Invitrogen). Cells are acquired using a Canto II flow cytometer (Beckton Dickinson). Flow cytometry data is analyzed using FlowJo software package (Tree Star, Inc.).

Determination of Virus Neutralizing Antibody Titers (VNT)

For the analysis of virus neutralizing titers (VNTs) of rat or mice sera, serial dilutions of heat-inactivated sera (56° C. for 30 min) are incubated with 100 TCID50 of SARS-CoV-2 tested in duplicates with a starting dilution of 1:10 followed by 1:2 serial dilutions.

To determine the breath of antibody responses, the following list of different virus strains can be employed:

ancestral SARS-CoV-2: strain 2019-nCov/Italy-INMI1, clade V (wild type Wuhan strain-like) (ancestral)

SARS CoV-2 isolate SARS-CoV-2/Huma n/ITA/PA-VIA1073 4/2020, clade G, D614G (D614G)

B.1.1.7 variant SARS-CoV-2: strain 14484 human swab isolated by VisMederi Research, which contains the following mutations compared to ancestral virus: N501Y, A570D, T572I, D614G, P681H, T716I, S735L, S982A, D1118H. Of note, these mutations differ from the consensus sequence of the variant4, i.e. deletions dH69/V70 and dY144 are missing and T572I and S735L represent additional mutations (alpha)

B.1.351 variant SARS-CoV-2: strain hCoV-19/Netherlands/NoordHolland_10159/2021, South African variant, nextstrain clade 20H, lineage B.1.351 supplied by the EVAg (beta)

B.1.617.2 variant SARS-CoV-2: hCoV-19/France/IDF-APHP-HEGP-20-23-2131905084/2021 EPI_ISL_202911312021-04-27, containing the following mutations: T19R E156G d157F d158R L452R T478K D614G P681R D950N (delta)

P.1 variant SARS-CoV-2 strain: PG_253 isolated by University of Siena, containing the following mutations: L18F T20N P26S D138Y R190S K417T E484K N501Y D614G H655Y T1027I and V1176F (gamma/P1)

BA.1 variant SARS-CoV-2: B.1.1.529 Omicron Variant Lot: MR_SARSCOV2_Omicronvariant_swabisolation_040122_C4 (omicron)

BA-5 variant strain
BQ.1.1 variant
BQ.1.2 variant
BQ.1.18 variant
XBB.1 variant
XBB.1.5 variant
XBB.1.16 variant
XBB.1.16.1 variant
XBB.1.17.1 variant
XBB.1.22 variant
XBB.2.3 variant
XBB.2.3.1 variant
XBB.2.3.2 variant
XAY-2 variant
FD2 variant
XBC.1 variant
XBC.2 variant XBF variant
CM.2 variant
BN.1 variant
BF.5 variant
BA.2.75 variant
BA.2.75.1 variant
BA.2.75.2 variant
BM1.1 variant
BM.1.1.1 variant
CA.1 variant
BU.1 variant
BJ.1 variant
BJ.1.v1 variant
BF.7 variant
BF.7.14 variant
CH.1.1 variant
CH.1.1.1 variant
CH.1.1.2 variant
DU.1 variant
EG.1 variant
EU.1.1 variant
FK.1 variant
XBC.1.6 variant
EG.5.1 variant
EG.5/FE.1 variant
XBB.2.3.3 variant
XBB.2.4 variant
GB.1 variant
FL.1/FL.1.3 variant
FV.1 variant
XBB.1.16.6 variant
XBB.1.19.1 variant
XBB.1.22.1 variant
EL.1 variant
XAY-1.1.1 variant
XBB.1.5.44 variant
Further emerging variant strains.

The virus is incubated for 1 hour at 37° C. Every plate contains a dedicated row (8 wells) for cell control, which contains only cells and medium, and a dedicated row of virus control, which contains only cells and virus. Infectious virus is quantified upon incubation of 100 µl of virus-serum mixture with a confluent layer of Vero E6 cells (ATCC, Cat.1586) followed by incubation for 3 days (ancestral SARS-CoV-2 and D614G) or 4 days (SARS-CoV-2 B.1.351, B.1.1.7, B.1.617.2, P.1, and BA.1) at 37° C. and microscopical scoring for CPE formation. A back titration is performed for each run in order to verify the correct range of TCID50 of the working virus solution. VN titers are calculated according to the method described by Reed & Muench. If no neutralization is observed (MNt <10), an arbitrary value of 5 is reported.

Example 3: Vaccination of Mice with mRNA Vaccines Encoding SARS-CoV-2 Variants

Within this study, it can be determined if vaccination with mRNA vaccines encoding SARS-CoV-2 variants induces immunogenicity with cross-neutralizing capacity.

Preparation and purification of LNP formulated mRNA vaccines are performed as described in in Example 1.

Immunization:

Mice are injected intramuscularly (i.m.) with mRNA vaccine compositions and doses as indicated in Table 4. As a negative control, one group of mice is vaccinated with buffer (group 1). All animals are vaccinated on day 0 and day 21. Blood samples are collected on day 0, day 14, day 21, and day 42 for the determination of antibody titers.

TABLE 4

| Vaccination regimen | | | | | |
|---|---|---|---|---|---|
| Group | Animals | mRNA | Dose | Immunisation schedule | Serum isolation |
| 1 | N = 8 | Neg. control: 0.9% NaCl | — | | |
| 2 | Balb/c female | R9709 (ancestral) | 1 µg | D 0 | D 0 |
| 3 | | RNA construct according to Table 3 | | D 21 | D 14 |
| 4 | | RNA construct according to Table 3 | | | D 21 |
| 5 | | RNA construct according to Table 3 | | | D 42 |
| 6 | | RNA construct according to Table 3 | | | |
| 7 | | RNA construct according to Table 3 | | | |
| 8 | | RNA construct according to Table 3 | | | |
| 9 | | RNA construct according to Table 3 | | | |

Determination VNTs with homologous and heterologous variants and T-cell analysis by Intracellular cytokine staining (ICS) are performed as described in Example 2. Further constructs encoding SARS-CoV-2 spike proteins according to the invention can be tested in a similar way.

Example 4: Challenge Studies in k18-hACE2 Mice or Hamsters

To determine the protective capacity of compositions or vaccines according to the invention, challenge studies in h18-hACE2 mice or in hamsters can be performed according to general procedures described e.g. in PCT Pub. Nos WO2021/156267 and WO2022/137133, the full disclosures of which are incorporated herein by reference.

Example 5

To demonstrate safety and efficiency or non-inferiority of the mRNA vaccine composition(s), a clinical trial (phase I) is initiated. In the clinical trial, a cohort of human volunteers is intramuscularly injected with mRNA encoding variant SARS-CoV-2 spike protein formulated in LNPs according to the invention. To assess the safety profile of the vaccine compositions according to the invention, subjects are monitored after administration (vital signs, vaccination site tolerability assessments, hematologic analysis). The efficacy of the immunization is analyzed by determination of virus neutralizing titers (VNT) in sera from vaccinated subjects. Blood samples are collected on day 0 as baseline and after completed vaccination. Sera are analyzed for virus neutralizing antibodies.

Example 6: Vaccination of Mice with mRNA Vaccines Encoding SARS-CoV-2 Variants

The objective of this study was to determine how immune evasive the BA.2 and BA.5-derived sublineages are compared to Omicron BA.5.

Preparation and purification of LNP formulated mRNA vaccines are performed as described in Example 1.

Immunization:

Mice were injected intramuscularly (i.m.) with mRNA vaccine compositions and doses as indicated in Table 5. As a negative control, one group of mice was vaccinated with buffer (group 1?). All animals were vaccinated on day 0 and day 28. Blood samples were collected at 18h, day 28, and day 42 for determination of ACE2 binding inhibition by neutralizing antibodies in an ACE2 binding inhibition assay.

ACE2 Binding Inhibition Assay Methodology

The ACE2 binding inhibition assay was based on a previously published multiplex competitive binding assay described by Junker et al. (COVID-19 patient serum less potently inhibits ACE2-RBD binding for various SARS-CoV-2 RBD mutants. Sci Rep 2022, 12, 7168). For each variant, ACE2 binding inhibition was calculated as a percentage, with 100% indicating maximum ACE2 binding inhibition and 0% indicating no ACE2 binding inhibition. ACE2 binding inhibition was tested towards RBDs of the following SARS-CoV-2 strains/variants: ancestral, alpha, beta, gamma, delta, BA.1+3 mut, BA.1, BA.2, BA.2.12.1, BA.4, BA.5, BA.2.75, BA.2.75.2, BF.7, XBB.1, BQ.1.1, lambda, mu, A23.1, epsilon, kappa, eta/iota, theta/zeta.

TABLE 5

Vaccination regimen

| Group | Animals | mRNA (reference to Table 3) | Dose | Immunisation schedule | Serum isolation | Ex vivo |
|---|---|---|---|---|---|---|
| 1 | N = 5 Balb/c female | NaCl | — | D 0 D 28 | 18 h D 28 D 42 | D 42 |
| 2 | N = 11 Balb/c female | R11506 (BA.5) | 0.25 μg | | | |
| 3 | | R11803 (BA.2.75) | | | | |
| 4 | | R11804 (BA.2.75.1) | | | | |
| 5 | | R11802 (BA.2.75.2) | | | | |
| 6 | | R11806 (BF7) | | | | |
| 7 | | R11805 (BQ.1.1) | | | | |
| 8 | | R11820 (XBB.1) | | | | |

T-cell analysis by Intracellular cytokine staining (ICS) (with SARS-CoV-2 omicron BA.5 or SARS-CoV-2 ancestral peptide libraries) were performed as described in Example 2. Further constructs encoding SARS-CoV-2 spike proteins according to the invention can be tested in a similar way.

Results

As seen in Table 6 and 7, LNP formulated mRNA vaccine compositions induced homologous and heterologous neutralizing responses towards several immune evasive SARS-CoV-2 variants. As seen in Table 6 below BF.7 vaccine elicits e.g. strong homologous and heterologous neutralizing responses towards BQ.1.1, BA.4 and BA.5 already at d28. BF.7 and BQ.1.1 vaccines elicit strong homologous neutralizing responses also at d42, they were also able to cross-neutralize their respective RBDs and BA.4/5 RBDs (see Table 7 below). BF.7 and BQ.1.1 also provided good cross-neutralizing capabilities towards BA.2.75, BA.2 and BA.2.12.1 RBDs at d42 (see Table 7 below). BA.2.75 vaccine could cross-neutralize BA.2, BA.2.12.1, BA.4, BA.5, BA.2.75, BA.2.75.2, BF.7 and BQ.1.1 RBDs (see Tables 6 and 7 below).

TABLE 6

Binding inhibition assay at d 28 (0.25 μg-dose)

| | BA.5 | BA.2.75 | BA.2.75.1 | BA.2.75.2 | BF.7 | BQ.1.1 | XBB.1 | Buffer |
|---|---|---|---|---|---|---|---|---|
| WT | 22.21 | 22.10 | 22.35 | 23.47 | 20.76 | 18.54 | 17.57 | 19.56 |
| alpha | 25.59 | 26.75 | 26.38 | 27.21 | 25.11 | 23.27 | 22.05 | 24.25 |
| beta | 17.20 | 22.69 | 18.85 | 20.84 | 16.10 | 16.00 | 14.80 | 16.69 |
| gamma | 14.48 | 19.82 | 14.96 | 16.99 | 17.85 | 18.36 | 15.54 | 15.46 |
| delta | 23.71 | 23.58 | 24.46 | 24.66 | 22.53 | 19.46 | 19.13 | 20.05 |
| BA.1 + 3 mut | 21.42 | 22.16 | 14.14 | 19.20 | 20.95 | 12.05 | 8.20 | 10.13 |
| BA.1 | 28.19 | 29.57 | 19.96 | 24.96 | 33.08 | 21.21 | 15.65 | 15.51 |
| BA.2 | 32.28 | 37.53 | 18.01 | 28.74 | 50.37 | 23.11 | 16.11 | 14.51 |
| BA.1.12.1 | 23.35 | 23.91 | 8.33 | 16.36 | 38.64 | 12.76 | 6.70 | 6.72 |
| BA.4 | 40.48 | 29.65 | 14.00 | 22.61 | 60.65 | 36.06 | 15.33 | 10.10 |

TABLE 6-continued

Binding inhibition assay at d 28 (0.25 µg-dose)

|  | BA.5 | BA.2.75 | BA.2.75.1 | BA.2.75.2 | BF.7 | BQ.1.1 | XBB.1 | Buffer |
|---|---|---|---|---|---|---|---|---|
| BA.5 | 33.81 | 21.96 | 8.46 | 16.44 | 54.98 | 30.36 | 10.53 | 5.78 |
| BA.2.75 | 23.88 | 29.87 | 10.36 | 19.09 | 30.06 | 17.43 | 10.95 | 9.72 |
| BA.2.75.2 | 23.24 | 21.70 | 10.15 | 21.52 | 25.18 | 12.71 | 10.83 | 5.55 |
| BF.7 | 38.17 | 27.51 | 12.11 | 22.85 | 56.15 | 33.83 | 12.22 | 7.50 |
| XBB.1 | 5.52 | 5.43 | 1.60 | 9.43 | 2.30 | 2.68 | 7.20 | 0.23 |
| BQ.1.1 | 39.64 | 31.66 | 17.68 | 27.36 | 59.19 | 39.44 | 19.72 | 14.96 |
| lambda | 6.22 | 9.88 | 9.03 | 10.82 | 5.82 | 5.55 | 4.73 | 5.73 |
| mu | 4.70 | 10.43 | 7.43 | 10.04 | 5.93 | 6.21 | 6.33 | 7.47 |
| A23.1 | 3.59 | 6.60 | 5.70 | 7.50 | 7.57 | 5.97 | 5.40 | 5.79 |
| epsilon | 5.38 | 7.39 | 7.74 | 8.57 | 9.63 | 6.47 | 6.30 | 7.60 |
| kappa | 4.24 | 13.76 | 5.59 | 7.56 | 7.81 | 4.17 | 2.22 | 4.05 |
| eta/iota | 4.73 | 12.60 | 7.77 | 10.99 | 5.40 | 5.30 | 5.71 | 5.80 |
| theta/zeta | 1.58 | 6.55 | 5.03 | 6.96 | 0.95 | 1.48 | 1.36 | 1.47 |

TABLE 7

Binding inhibition assay at d 42 (0.25 µg-dose)

|  | BA.5 | BA.2.75 | BA.2.75.1 | BA.2.75.2 | BF.7 | BQ.1.1 | XBB.1 | Buffer |
|---|---|---|---|---|---|---|---|---|
| WT | 1.71 | 14.82 | 0.16 | 2.76 | 9.94 | 6.25 | 1.48 | 0.51 |
| alpha | 3.78 | 15.44 | 1.65 | 2.15 | 8.71 | 6.22 | 2.26 | 0.94 |
| beta | 1.03 | 18.79 | 0.13 | 0.65 | 3.76 | 2.85 | 0.54 | 0.24 |
| gamma | 2.78 | 22.30 | 0.27 | 3.08 | 8.19 | 7.10 | 2.98 | 0.20 |
| delta | 3.05 | 17.07 | 1.30 | 1.59 | 10.52 | 6.90 | 1.51 | 0.98 |
| BA.1 + 3 mut | 9.17 | 24.47 | 0.00 | 11.80 | 17.75 | 9.83 | 0.00 | 0.00 |
| BA.1 | 12.40 | 32.20 | 0.04 | 14.55 | 27.81 | 13.57 | 0.36 | 0.00 |
| BA.2 | 27.79 | 53.45 | 1.34 | 30.43 | 48.16 | 27.66 | 0.98 | 0.00 |
| BA.2.12.1 | 20.96 | 43.32 | 0.00 | 19.67 | 38.76 | 20.64 | 0.99 | 0.00 |
| BA.4 | 42.11 | 43.82 | 0.19 | 24.60 | 67.93 | 55.23 | 3.06 | 0.00 |
| BA.5 | 35.61 | 38.90 | 0.10 | 18.54 | 62.89 | 50.07 | 1.54 | 0.00 |
| BA.2.75 | 18.39 | 45.47 | 0.00 | 23.70 | 35.29 | 22.83 | 0.19 | 0.00 |
| BA.2.75.2 | 23.01 | 35.86 | 0.09 | 37.46 | 43.37 | 26.75 | 5.38 | 0.00 |
| BF.7 | 39.41 | 41.47 | 0.00 | 23.10 | 65.30 | 53.11 | 1.17 | 0.00 |
| XBB.1 | 7.21 | 13.96 | 0.00 | 16.38 | 10.00 | 9.04 | 17.42 | 0.00 |
| BQ.1.1 | 40.50 | 47.25 | 3.15 | 27.52 | 67.86 | 56.37 | 5.98 | 0.72 |
| lambda | 1.69 | 16.03 | 0.13 | 1.15 | 5.50 | 6.96 | 2.40 | 1.44 |
| mu | 1.80 | 14.83 | 0.10 | 1.59 | 3.02 | 2.49 | 0.07 | 0.95 |
| A23.1 | 2.69 | 16.73 | 0.82 | 3.77 | 11.47 | 8.96 | 2.19 | 1.59 |
| epsilon | 2.53 | 13.96 | 0.79 | 1.42 | 8.08 | 5.35 | 0.62 | 0.52 |
| kappa | 5.49 | 30.17 | 1.54 | 4.09 | 15.46 | 11.71 | 0.23 | 0.35 |
| eta/iota | 2.13 | 20.72 | 0.19 | 3.92 | 9.13 | 7.41 | 1.23 | 1.24 |
| theta/zeta | 0.78 | 13.10 | 0.36 | 0.67 | 2.83 | 2.73 | 0.18 | 0.42 |

Example 7: Vaccination of Rats with mRNA Vaccines Encoding SARS-CoV-2 Variants

The objective of the study was to determine how immunogenic a XBB.1-based vaccine is and whether XBB.1-based and XBB.1.5-based vaccines are similarly immunogenic and cross-neutralizing towards other SARS-CoV-2 variants.

Preparation and purification of LNP formulated mRNA vaccines are performed as described in Example 1.

Immunization:

Rats were injected intramuscularly (i.m.) with mRNA vaccine compositions (1 methylpseudouridine) and doses as indicated in Table 8. As a negative control, one group of rats was vaccinated with buffer (group 1). All animals were vaccinated on day 0 and day 21. Blood samples were collected at 14h, day 14, day 21 and day 42 for the determination of ACE2 binding inhibition in an ACE2 binding inhibition assay.

TABLE 8

Vaccination regimen

| Group | Animals | Vaccines | Dose | Immunisation schedule | Serum isolation |
|---|---|---|---|---|---|
| 1 | Wistar Female N = 6 | Buffer (NaCl) |  | D 0 D 21 | 14 h D 14 D 21 |
| 2 | Wistar Female N = 8 | R11506 (BA.5) | 2 µg |  | D 42 |
| 3 |  | R11805 (BQ.1.1) |  |  |  |
| 4 |  | R11820 (XBB.1) |  |  |  |
| 5 |  | R12018 (XBB.1.5) |  |  |  |
| 6 |  | R12036 (CH.1.1) |  |  |  |

Further constructs encoding SARS-CoV-2 spike proteins according to the invention can be tested in a similar way.

ACE2 Binding Inhibition Assay Methodology is Performed Accordingly to Example 6.

Determination of Virus Neutralizing Antibody Titers (VNT)

Sera from groups 2, 4 and 5 were analyzed for their virus neutralizing capacity. Therefore, serial dilutions of heat-inactivated sera (56° C. for 30 min) were incubated with 100

TCID50 of SARS-CoV-2 BA.5, XBB.1 or XBB.1.5.6 tested in duplicates with a starting dilution of 1:10 followed by 1:2 serial dilutions.

The virus was incubated for 1 hour at 37° C. Every plate contained a dedicated row (8 wells) for cell control, which contained only cells and medium, and a dedicated row of virus control, which contained only cells and virus. Infectious virus was quantified upon incubation of 100 µl of virus-serum mixture with a confluent layer of Vero E6 cells (ATCC, Cat.1586) followed by incubation for 4 days (SARS-CoV-2 BA.5, XBB.1, or XBB.1.5.6) at 37° C. and microscopical scoring for CPE formation. A back titration was performed for each run in order to verify the correct range of TCID50 of the working virus solution. VN titers were calculated according to the method described by Reed & Muench. If no neutralization was observed (MNt <10), an arbitrary value of 5 is reported.

XBB.1.5.6 differs from XBB.1.5 in two mutations in the spike protein, i.e. A678Y and V948I. Both mutations are located in S2 part of the protein. They are no direct targets for neutralizing antibodies but may affect factors such as protein stability or conformation. While variations in neutralizing antibody titres directed against XBB.1.5.6 and XBB.1.5. are therefor possible, it seems likely that the titres are overall comparable.

Results:

As observed in Tables 9, 10 and 11 below, both XBB.1 and XBB.1.5 provided effective cross-neutralization towards BF.7, BQ.1.1 at d14, d21 and d42, respectively. XBB.1 and XBB.1.5 showed significant (cross-)neutralization against their respective RBDs (see Tables 9, 10 and 11).

TABLE 9

Binding inhibition assay at d 14 (2 µg dose)

|  | buffer | BA.5 | BQ.1.1 | XBB.1 | XBB.1.5 | CH.1.1 | pos ctrl |
| --- | --- | --- | --- | --- | --- | --- | --- |
| WT | 5.3 | 9.6 | 12.9 | 10.4 | 13.6 | 14.9 | 98.99 |
| alpha | 6.8 | 9.8 | 11.9 | 10.5 | 13.5 | 13.3 | 97.63 |
| beta | 3.5 | 6.9 | 10.0 | 6.0 | 8.8 | 8.5 | 97.99 |
| gamma | 3.6 | 8.0 | 11.4 | 6.9 | 9.7 | 9.3 | 97.49 |
| delta | 4.5 | 9.1 | 13.3 | 8.4 | 12.3 | 14.5 | 98.48 |
| BA.1 + 3 mut | 0.5 | 4.5 | 13.1 | 5.3 | 16.8 | 18.7 | 96.73 |
| BA.1 | 0.4 | 5.8 | 11.7 | 4.6 | 12.6 | 15.7 | 94.87 |
| BA.2 | 0.0 | 14.7 | 22.0 | 16.7 | 27.3 | 26.6 | 96.47 |
| BA.2.12.1 | 0.2 | 18.8 | 29.2 | 21.1 | 32.4 | 34.9 | 97.20 |
| BA.4 | 0.0 | 27.5 | 45.5 | 19.7 | 28.7 | 33.9 | 88.53 |
| BA.5 | 0.1 | 28.3 | 43.8 | 19.9 | 29.5 | 33.7 | 87.18 |
| BA.2.75 | 1.6 | 11.7 | 21.6 | 17.9 | 26.4 | 27.7 | 93.54 |
| BA.2.75.2 | 0.0 | 9.2 | 16.3 | 16.8 | 28.6 | 27.0 | 85.08 |
| BF.7 | 9.0 | 42.2 | 61.6 | 36.3 | 46.2 | 49.1 | 93.28 |
| BQ.1.1 | 1.8 | 27.6 | 54.8 | 28.4 | 37.6 | 42.9 | 85.52 |
| XBB.1 | 0.1 | 6.6 | 20.3 | 34.6 | 49.1 | 25.4 | 69.08 |
| XBB.1.5 | 1.6 | 17.2 | 31.4 | 38.6 | 53.2 | 34.6 | 72.82 |

TABLE 10

Binding inhibition assay at d 21 (2 µg dose)

|  | buffer | BA.5 | BQ.1.1 | XBB.1 | XBB.1.5 | CH.1.1 | pos ctrl |
| --- | --- | --- | --- | --- | --- | --- | --- |
| WT | 2.8 | 6.6 | 8.8 | 7.8 | 11.8 | 13.4 | 99.10 |
| alpha | 3.3 | 5.8 | 6.1 | 6.8 | 10.9 | 10.0 | 97.90 |
| beta | 0.4 | 3.6 | 3.8 | 3.9 | 6.8 | 7.1 | 98.17 |
| gamma | 2.5 | 6.4 | 7.7 | 6.5 | 10.3 | 9.9 | 97.81 |
| delta | 2.6 | 6.2 | 9.9 | 7.1 | 11.6 | 13.5 | 98.69 |
| BA.1 + 3 mut | 0.0 | 1.3 | 8.0 | 3.0 | 12.5 | 13.8 | 97.03 |
| BA.1 | 0.0 | 2.6 | 7.9 | 1.6 | 8.4 | 10.9 | 94.95 |
| BA.2 | 0.0 | 11.8 | 18.7 | 13.1 | 22.4 | 20.3 | 96.91 |
| BA.2.12.1 | 0.0 | 15.5 | 24.0 | 16.9 | 28.2 | 30.8 | 97.48 |
| BA.4 | 0.0 | 26.1 | 42.8 | 18.1 | 27.5 | 32.3 | 89.42 |
| BA.5 | 0.0 | 24.7 | 39.2 | 15.3 | 25.1 | 29.6 | 88.47 |
| BA.2.75 | 0.0 | 8.1 | 17.4 | 14.8 | 23.2 | 23.2 | 94.37 |
| BA.2.75.2 | 0.0 | 8.0 | 18.3 | 17.2 | 29.6 | 26.9 | 86.45 |
| BF.7 | 6.2 | 38.9 | 57.5 | 32.9 | 42.7 | 46.5 | 93.62 |
| BQ.1.1 | 0.0 | 25.1 | 51.1 | 25.0 | 34.6 | 40.2 | 86.20 |
| XBB.1 | 0.0 | 3.6 | 22.6 | 33.1 | 48.3 | 27.1 | 71.60 |
| XBB.1.5 | 0.3 | 12.3 | 28.9 | 34.1 | 48.9 | 30.8 | 70.94 |

TABLE 11

Binding inhibition assay at d 42 (2 µg dose)

|  | buffer | BA.5 | BQ.1.1 | XBB.1 | XBB.1.5 | CH.1.1 | pos ctrl |
| --- | --- | --- | --- | --- | --- | --- | --- |
| WT | 2.3 | 35.0 | 46.6 | 27.2 | 40.5 | 48.3 | 97.20 |
| alpha | 0.4 | 25.8 | 32.5 | 17.2 | 33.3 | 36.6 | 93.59 |
| beta | 0.2 | 30.4 | 30.1 | 14.0 | 33.9 | 36.5 | 94.07 |

TABLE 11-continued

Binding inhibition assay at d 42 (2 µg dose)

|  | buffer | BA.5 | BQ.1.1 | XBB.1 | XBB.1.5 | CH.1.1 | pos ctrl |
|---|---|---|---|---|---|---|---|
| gamma | 1.3 | 32.9 | 33.9 | 17.4 | 38.3 | 39.2 | 92.70 |
| delta | 0.6 | 36.2 | 47.7 | 17.8 | 36.6 | 45.2 | 95.63 |
| BA.1 + 3 mut | 0.0 | 33.3 | 60.8 | 32.9 | 57.6 | 56.4 | 90.77 |
| BA.1 | 0.0 | 41.2 | 59.0 | 21.7 | 45.1 | 42.5 | 84.87 |
| BA.2 | 0.0 | 63.6 | 77.6 | 60.6 | 78.5 | 62.5 | 89.75 |
| BA.2.12.1 | 0.0 | 70.2 | 80.3 | 65.3 | 81.4 | 68.5 | 91.64 |
| BA.4 | 0.0 | 83.7 | 89.5 | 67.9 | 82.0 | 76.8 | 74.26 |
| BA.5 | 0.0 | 80.8 | 87.0 | 62.5 | 79.3 | 72.8 | 70.87 |
| BA.2.75 | 0.0 | 46.2 | 68.4 | 54.9 | 74.2 | 63.1 | 82.64 |
| BA.2.75.2 | 0.0 | 59.3 | 79.5 | 72.5 | 87.4 | 78.2 | 70.19 |
| BF.7 | 2.7 | 86.8 | 92.5 | 74.9 | 87.5 | 83.8 | 81.47 |
| BQ.1.1 | 0.1 | 79.8 | 91.7 | 73.1 | 85.9 | 83.1 | 69.04 |
| XBB.1 | 0.0 | 53.5 | 78.7 | 85.0 | 91.4 | 74.9 | 51.08 |
| XBB.1.5 | 0.1 | 57.5 | 79.4 | 82.3 | 93.5 | 74.7 | 52.53 |

As also seen in Tables 9, 10 and 11, BQ.1.1 showed strong cross-neutralization against BA.4/5 RBDs, as well as BA.2, BA.2.75, BA.2.75.2, BA.2.12.1 RBDs after two immunizations on d42, which further confirmed the results of example 6. Furthermore, BQ.1.1 proved to possess significant cross-neutralization activity against BF.7, XBB.1 and XBB.1.5 at d42 (see Table 11).

Figure 2:
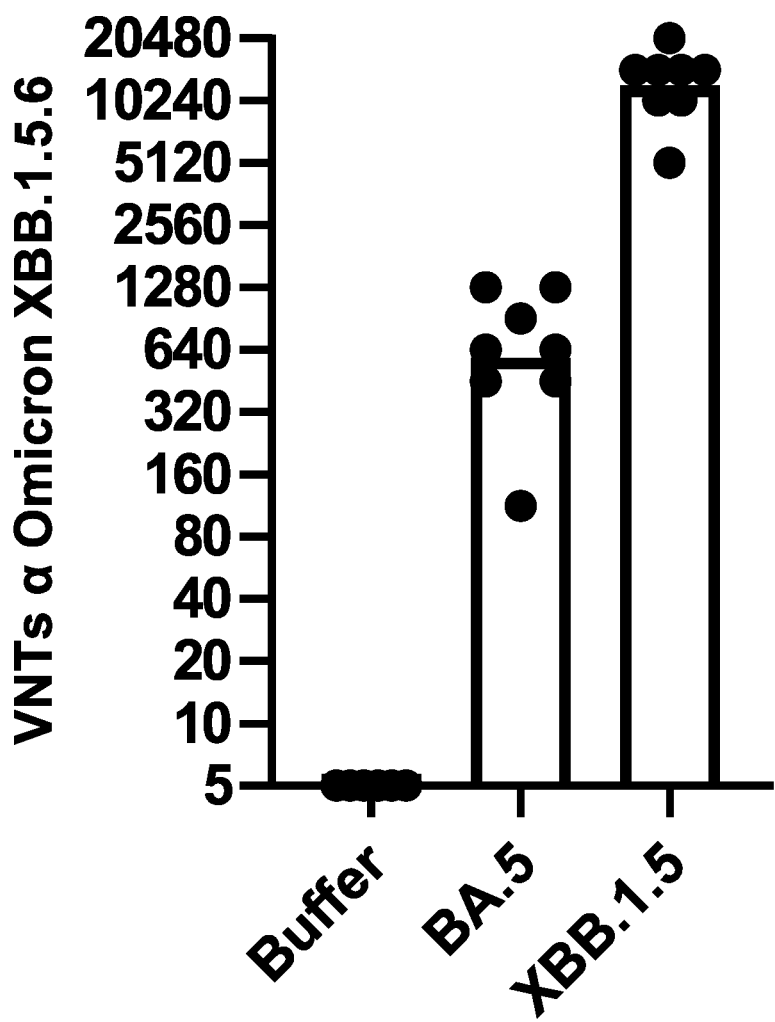
FIG. 2: Virus Neutralization Titers (VNT) against Omicron XBB.1.5.6 were monitored as described for FIG. 1.
Figure 3:
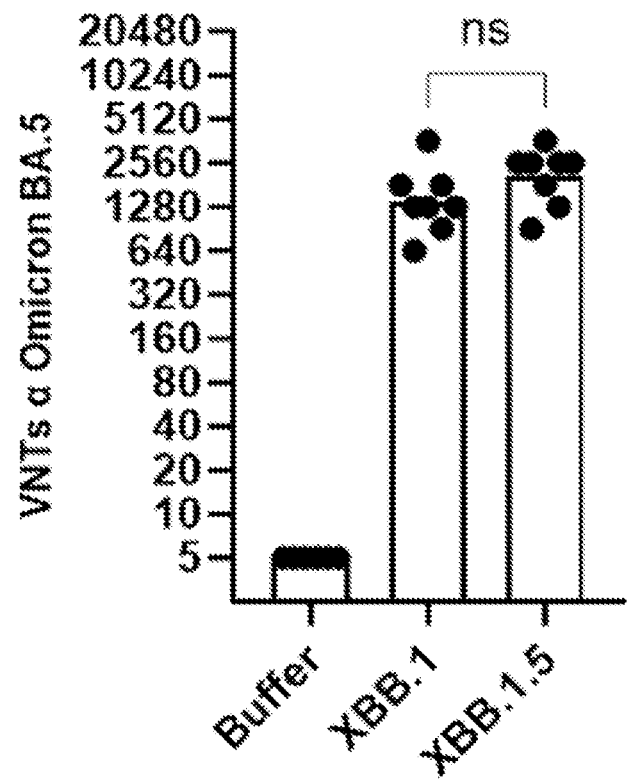
FIG. 3: Virus Neutralization Titers (VNT) against Omicron BA.5 were monitored as described for FIG. 1.
Figure 4:
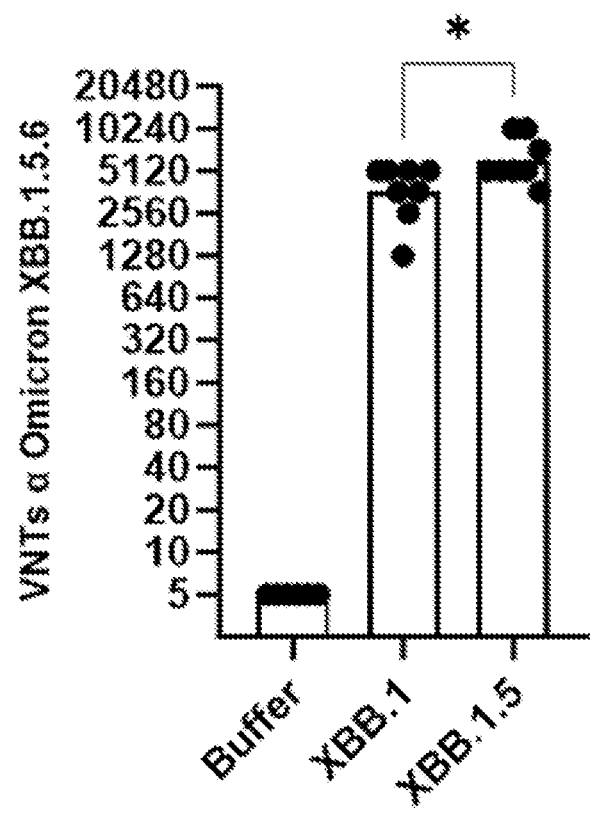
FIG. 4: Virus Neutralization Titers (VNT) against Omicron XBB.1.5.6 were monitored as described for FIG. 1.
Figure 5:
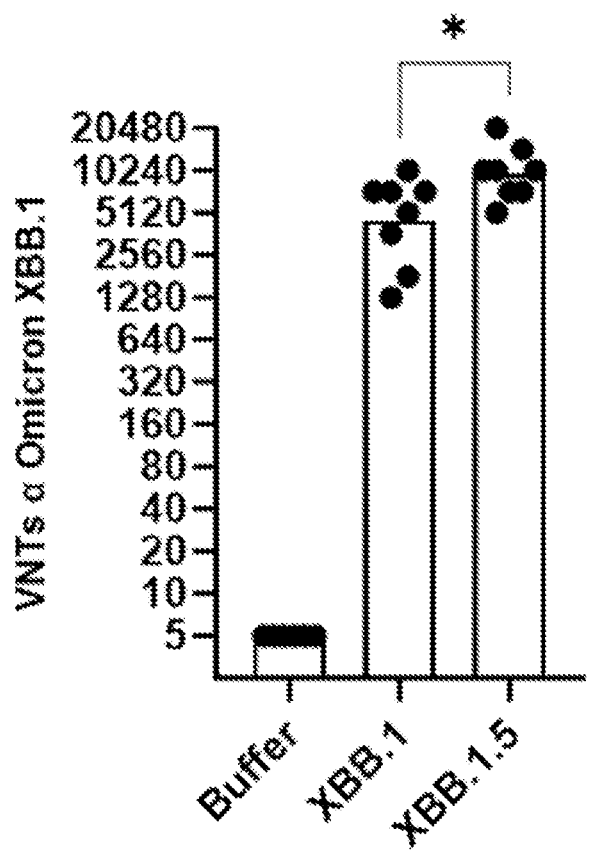
FIG. 5: Virus Neutralization Titers (VNT) against Omicron XBB.1 were monitored as described for FIG. 1.

Finally, as shown in FIG. 1, BA.5 and XBB.1.5 induced comparable VNTs against SARS-CoV-2 Omicron BA.5 strain. This result indicates that XBB.1.5 offers good cross-neutralization of SARS-CoV-2 Omicron BA.5. FIG. 2 also showed that XBB.1.5 is better at neutralizing SARS-CoV-2 XBB.1.5.6 strain compared to Omicron BA.5. FIGS. 3, 4 and 5 demonstrate functional antibody responses (VNTs) in rat sera vaccinated with XBB.1 or XBB.1.5-based mRNA vaccine composition against the Omicron BA.5 (FIG. 3), against XBB.1.5.6 (FIG. 4) and against Omicron XBB.1 (FIG. 5). The XBB.1.5 based vaccine induced higher VNTs as compared to the XBB.1-based vaccine, even against the heterologous SARS-CoV-2 variant XBB.1 (see FIG. 5).

Example 8: Vaccination of Mice with mRNA Vaccines Encoding SARS-CoV-2 Variants

The objective of this study was to assess immunogenicity of the XBB.1.5-based vaccine in mice in a dose-response study.

Preparation and purification of LNP formulated mRNA vaccines are performed as described in in Example 1.
Immunization:

Mice were injected intramuscularly (i.m.) with mRNA vaccine compositions and doses as indicated in Table 12. As a negative control, one group of mice is vaccinated with buffer (group 4). All animals were vaccinated on day 0 and day 28. Blood samples were collected on day 28 and day 42 for the determination of antibody titers. Splenocytes were isolated according to a standard protocol known in the art (see Example 2) to analyze T cell responses.

TABLE 12

Vaccination regimen

| Group | Animals | mRNA | Dose | Immunisation schedule | Sample collection Serum | Splenocytes |
|---|---|---|---|---|---|---|
| 1 | N = 16 | R12018 (XBB.1.5) | 0.3 µg, 20 µl | Day 0 | d 28, d 42 | d 42 |
| 2 | Balb/c female | R12018 (XBB.1.5) | 0.45 µg, 20 µl | Day 28 | | |
| 3 |  | R12018 (XBB.1.5) | 0.675 µg, 20 µl | | | |
| 4 | N = 8 Balb/c female | 0.9% NaCl | —, 20 µl | | | |

Determination of Virus Neutralizing Antibody Titers (VNT)

For the analysis of virus neutralizing titers (VNTs) of mice sera, serial dilutions of heat-inactivated sera (56° C. for 30 min) were incubated with 100 TCID50 of SARS-CoV-2 XBB.1.5.6 tested in duplicates with a starting dilution of 1:10 followed by 1:2 serial dilutions.

The virus was incubated for 1 hour at 37° C. Every plate contained a dedicated row (8 wells) for cell control, which contained only cells and medium, and a dedicated row of virus control, which contained only cells and virus. Infectious virus was quantified upon incubation of 100 µl of virus-serum mixture with a confluent layer of Vero E6 cells (ATCC, Cat.1586) followed by incubation for 4 days (SARS-CoV-2 XBB.1.5.6) at 37° C. and microscopical scoring for CPE formation. A back titration was performed for each run in order to verify the correct range of TCID50 of the working virus solution. VN titers were calculated according to the method described by Reed & Muench. If no neutralization was observed (MNt <10), an arbitrary value of 5 is reported.

Figure 6:
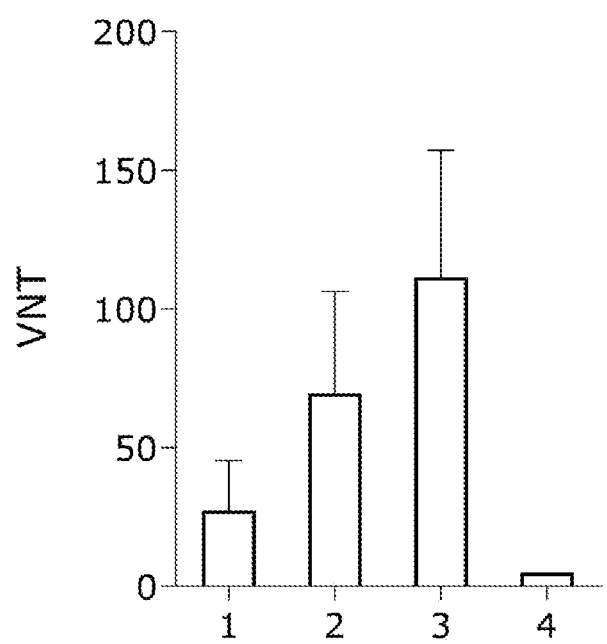
FIG. 6: Virus Neutralization Titers (VNT) against Omicron XBB.1.5.6. (Example 8).

XBB.1.5.6 differs from XBB.1.5 in two mutations in the spike protein, i.e. A678Y and V948I. Both mutations are located in S2 part of the protein. They are no direct targets for neutralizing antibodies but may affect factors such as protein stability or conformation. While variations in neutralizing antibody titres directed against XBB.1.5.6 and XBB.1.5. are therefor possible, it seems likely that the titres are overall comparable.
Results:

As shown in FIG. 6, robust virus neutralizing titers (VNTs) were induced against SARS-CoV-2 variant XBB.1.5.6 in a dose dependent manner. VNTs were detectable 28 days after only one injection for all groups.

SEQUENCE LISTING (315 sequences)

SEQ ID NO: 1 - protein, 1273 aa, Severe acute respiratory syndrome coronavirus 2
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDKVEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 2 - protein, 1273 aa, synthetic construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQDVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 3 - DNA, 62 bp, Homo sapiens
  source 1..62: mol_type = genomic DNA
gtcccgcagtcggcgtccagcggctctgcttgttcgtgtgtgtgtcgttgcaggccttattc

SEQ ID NO: 4 - RNA, 62 nt, Homo sapiens
  source 1..62: mol_type = mRNA
gtcccgcagtcggcgtccagcggctctgcttgttcgtgtgtgtgtcgttgcaggccttattc

SEQ ID NO: 5 - DNA, 77 bp, synthetic construct
  source 1..77: mol_type = other DNA
aggagagtcccgcagtcggcgtccagcggctctgcttgttcgtgtgtgtgtcgttgcaggccttattcaagcttacc

SEQ ID NO: 6 - RNA, 77 nt, synthetic construct
  source 1..77: mol_type = other RNA
aggagagtcccgcagtcggcgtccagcggctctgcttgttcgtgtgtgtgtcgttgcaggccttattcaagcttacc

SEQ ID NO: 7 - DNA, 45 bp, synthetic construct
  source 1..45: mol_type = other DNA
taagagagaaaagaagagtaagaagaaatataagaccccggcgcc

SEQ ID NO: 8 - RNA, 45 nt, synthetic construct
  source 1..45: mol_type = other RNA
taagagagaaaagaagagtaagaagaaatataagaccccggcgcc

SEQ ID NO: 9 - DNA, 57 bp, synthetic construct
  source 1..57: mol_type = other DNA
gggaaataagagagaaaagaagagtaagaagaaatataagaccccggcgccgccacc

SEQ ID NO: 10 - RNA, 57 nt, synthetic construct
  source 1..57: mol_type = other RNA
gggaaataagagagaaaagaagagtaagaagaaatataagaccccggcgccgccacc

SEQ ID NO: 11 - DNA, 41 bp, Homo sapiens
  source 1..41: mol_type = genomic DNA
aactagtattcttctggtccccacagactcagagagaaccc

SEQ ID NO: 12 - RNA, 41 nt, Homo sapiens
  source 1..41: mol_type = mRNA
aactagtattcttctggtccccacagactcagagagaaccc

SEQ ID NO: 13 - DNA, 53 bp, synthetic construct
  source 1..53: mol_type = other DNA
agaataaactagtattcttctggtccccacagactcagagagaacccgccacc

SEQ ID NO: 14 - RNA, 53 nt, synthetic construct
  source 1..53: mol_type = other RNA
agaataaactagtattcttctggtccccacagactcagagagaacccgccacc

SEQ ID NO: 15 - DNA, 137 bp, Human betaherpesvirus 5
  source 1..137: mol_type = genomic DNA
cagatcgcctggagacgccatccacgctgttttgacctccatagaagacaccgggaccgatccagcctccgcggccgggaacggtgcattggaacgcggattccccgtgccaagagtgactcaccgtccttgacacg

SEQ ID NO: 16 - RNA, 137 nt, Human betaherpesvirus 5
  source 1..137: mol_type = mRNA
cagatcgcctggagacgccatccacgctgttttgacctccatagaagacaccgggaccgatccagcctccgcggccgggaacggtgcattggaacgcggattccccgtgccaagagtgactcaccgtccttgacacg

SEQ ID NO: 17 - DNA, 140 bp, synthetic construct
  source 1..140: mol_type = other DNA
ggacagatcgcctggagacgccatccacgctgttttgacctccatagaagacaccgggaccgatccagcctccgcggccgggaacggtgcattggaacgcggattccccgtgccaagagtgactcaccgtccttgacacg

SEQ ID NO: 18 - RNA, 140 nt, synthetic construct
  source 1..140: mol_type = other RNA
ggacagatcgcctggagacgccatccacgctgttttgacctccatagaagacaccgggaccgatccagcctccgcggccgggaacggtgcattggaacgcggattccccgtgccaagagtgactcaccgtccttgacacg

SEQ ID NO: 19 - DNA, 57 bp, Homo sapiens
  source 1..57: mol_type = genomic DNA
ccctgttcccagagcccacttttttttctttttttgaaataaaatagcctgtctttc

SEQ ID NO: 20 - RNA, 57 nt, Homo sapiens
  source 1..57: mol_type = mRNA
ccctgttcccagagcccacttttttttctttttttgaaataaaatagcctgtctttc

SEQ ID NO: 21 - DNA, 77 bp, Homo sapiens
  source 1..77: mol_type = genomic DNA
tgatgaggactagtccctgttcccagagcccacttttttttctttttttgaaataaaatagcctgtctttcagatct

SEQ ID NO: 22 - RNA, 77 nt, Homo sapiens
  source 1..77: mol_type = mRNA
tgatgaggactagtccctgttcccagagcccacttttttttctttttttgaaataaaatagcctgtctttcagatct

SEQ ID NO: 23 - DNA, 110 bp, synthetic construct
  source 1..110: mol_type = other DNA
gctggagcctcggtggcctagcttcttgccccttgggcctccccccagcccctcctccccttcctgcacccgtacccccgtggtctttgaataaagtctgagtgggcggc

SEQ ID NO: 24 - RNA, 110 nt, synthetic construct
  source 1..110: mol_type = other RNA
gctggagcctcggtggcctagcttcttgccccttgggcctccccccagcccctcctccccttcctgcacccgtacccccgtggtctttgaataaagtctgagtgggcggc

SEQ ID NO: 25 - DNA, 119 bp, synthetic construct
  source 1..119: mol_type = other DNA
tgataataggctggagcctcggtggcctagcttcttgccccttgggcctccccccagcccctcctccccttcctgcacccgtacccccgtggtctttgaataaagtctgagtgggcggc

SEQ ID NO: 26 - RNA, 119 nt, synthetic construct
  source 1..119: mol_type = other RNA
tgataataggctggagcctcggtggcctagcttcttgccccttgggcctccccccagcccctcctccccttcctgcacccgtacccccgtggtctttgaataaagtctgagtgggcggc

SEQ ID NO: 27 - DNA, 113 bp, synthetic construct
  source 1..113: mol_type = other DNA
gctggagcctcggtggcctagcttcttgccccttgggcctccccccagcccctcctccccttcctgcaggagagatagtggagtggtctttgaataaagtctgagtgggcggc

SEQ ID NO: 28 - RNA, 113 nt, synthetic construct
  source 1..113: mol_type = other RNA
gctggagcctcggtggcctagcttcttgccccttgggcctccccccagcccctcctccccttcctgcaggagagatagtggagtggtctttgaataaagtctgagtgggcggc

SEQ ID NO: 29 - DNA, 122 bp, synthetic construct
  source 1..122: mol_type = other DNA
tgataataggctggagcctcggtggcctagcttcttgccccttgggcctccccccagcccctcctccccttcctgcaggagagatagtggagtggtctttgaataaagtctgagtgggcggc

SEQ ID NO: 30 - RNA, 122 nt, synthetic construct
  source 1..122: mol_type = other RNA
tgataataggctggagcctcggtggcctagcttcttgccccttgggcctccccccagcccctcctccccttcctgcaggagagatagtggagtggtctttgaataaagtctgagtgggcggc

SEQ ID NO: 31 - DNA, 295 bp, synthetic construct
  source 1..295: mol_type = other DNA
ctcgagctggtactgcatgcacgcaatgctagctgcccctttcccgtcctgggtaccccgagtctcccccgacctcgggtcccaggtatgctcccacctccacctgccccactcaccacctctgctagttccagacacctcccaagcacgcagcaatgcagctcaaaacgcttagcctagccacacccccacgggaaacagcagtgattaacctttagcaataaacgaaagtttaactaagctatactaaccccagggttggtcaatttcgtgccagccacaccctggagctagc

SEQ ID NO: 32 - RNA, 295 nt, synthetic construct
  source 1..295: mol_type = other RNA
ctcgagctggtactgcatgcacgcaatgctagctgcccctttcccgtcctgggtaccccgagtctcccccgacctcgggtcccaggtatgctcccacctccacctgccccactcaccacctctgctagttccagacacctcccaagcacgcagcaatgcagctcaaaacgcttagcctagccacacccccacgggaaacagcagtgattaacctttagcaataaacgaaagtttaactaagctatactaaccccagggttggtcaatttcgtgccagccacaccctggagctagc

SEQ ID NO: 33 - DNA, 102 bp, Homo sapiens
  source 1..102: mol_type = genomic DNA
cgggtggcatccctgtgacccctccccagtgcctctcctggccctggaagttgccactccagtgcccaccagccttgtcctaataaaattaagttgcatcaa

SEQ ID NO: 34 - RNA, 102 nt, Homo sapiens
  source 1..102: mol_type = mRNA
cgggtggcatccctgtgacccctccccagtgcctctcctggccctggaagttgccactccagtgcccaccagccttgtcctaataaaattaagttgcatcaa

SEQ ID NO: 35 - DNA, 105 bp, synthetic construct
  source 1..105: mol_type = other DNA
cgggtggcatccctgtgacccctccccagtgcctctcctggccctggaagttgccactccagtgcccaccagccttgtcctaataaaattaagttgcatcaagct

SEQ ID NO: 36 - RNA, 105 nt, synthetic construct
  source 1..105: mol_type = other RNA
cgggtggcatccctgtgacccctccccagtgcctctcctggccctggaagttgccactccagtgcccaccagccttgtcctaataaaattaagttgcatcaagct

SEQ ID NO: 37 - DNA, 24 bp, Homo sapiens
  source 1..24: mol_type = genomic DNA
caaaggctcttttcagagccacca

SEQ ID NO: 38 - RNA, 24 nt, Homo sapiens
  source 1..24: mol_type = mRNA
caaaggctcttttcagagccacca

SEQ ID NO: 39 - RNA, 124 nt, synthetic construct
  source 1..124: mol_type = other RNA
caaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 40 - RNA, 129 nt, synthetic construct
  source 1..129: mol_type = other RNA
caaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaatt

SEQ ID NO: 41 - RNA, 100 nt, synthetic construct
  source 1..100: mol_type = other RNA
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 42 - RNA, 105 nt, synthetic construct
  source 1..105: mol_type = other RNA
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaagaatt

SEQ ID NO: 43 - RNA, 105 nt, synthetic construct
  source 1..105: mol_type = other RNA
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 44 - RNA, 110 nt, synthetic construct
  source 1..110: mol_type = other RNA
aaaaaaaaaaaaaaaaaaaaaaaaaaaaaagcatatgactaaaaaaaaaaaaaaaaaaaaaaaaaaaaaaaaaaaaaaaaaaaaaaaaaaaaaaaaaaaaaaaaaaaaaa

SEQ ID NO: 45 - protein, 1269 aa, synthetic construct
MFVFLVLLPLVSSQCVNLITRTQSYTNSFTRGVYYPDKVFRSSVLHSTQDLFLPFFSNVTWFHAIHVSGTNGTKRFDNPALPFNDGVYFASTEKSNIIRGWIFGTTLDSKTQSLLIVNNATNVVIKVCEFQFCNDPFLDVYQKNNKSWMESEFRVYSSANNCTFEYVSQPFLMDLEGKEGNFKNLREFVFKNIDGYFKIYSKHTPINLERDLPQGFSALEPLVDLPIGINITRFQTLLALHRSYLTPVDSSSGWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVIYNFAPFFAFKCYGVSPTKLNDLCFTNVYADSFVIRGNEVSQIAPGQTGNIADYNYKLPDDFTGCVIAWNSNKLDSKPSGNYNYLYRLFRKSKLKPFERDISTEIYQAGNKPCNGVAGSNCYSPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 46 - protein, 1269 aa, synthetic construct
MFVFLVLLPLVSSQCVNLITRTQSYTNSFTRGVYYPDKVFRSSVLHSTQDLFLPFFSNVTWFHAIHVSGTNGTKRFDNPALPFNDGVYFASTEKSNIIRGWIFGTTLDSKTQSLLIVNNATNVVIKVCEFQFCNDPFLDVYQKNNKSWMESEFRVYSSANNCTFEYVSQPFLMDLEGKEGNFKNLREFVFKNIDGYFKIYSKHTPINLERDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVIYNFAPFFAFKCYGVSPTKLNDLCFTNVYADSFVIRGNEVSQIAPGQTGNIADYNYKLPDDFTGCVIAWNSNKLDSKPSGNYNYLYRLFRKSNLKPFERDISTEIYQAGNKPCNGAAGFNCYVPLRSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFDGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQILQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 47 - protein, 1268 aa, synthetic construct
MFVFLVLLPLVSSQCVNLITRTQSYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLDVYYHKNNKSWMESEFRVYSSANNCTFEYVSQPFLMDLEGKQGNFKNLREFVFKNIDGYFKIYSKHTPINLGRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFDEVFNATTFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSTVGGNYNYRYRLFRKSKLKPFERDISTEIYQAGNKPCNGVAGVNCYFPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 48 - protein, 1267 aa, synthetic construct
MFVFLVLLPLVSSQCVNLITRTQSYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLDVYHKNNKSWMESEFRVYSSANNCTFEYVSQPFLMDLEGKQGNFKNLREFVFKNIDGYFKIYSKHTPINLGRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFDEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSMVGGNYNYRYRLFRKSKLKPFERDISTEIYQAGNKPCNGVAGVNCYFPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 49 - protein, 1268 aa, synthetic construct
MFVFLVLLPLVSSQCVNLITRTQSYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLDVYYHKNNKSWMESEFRVYSSANNCTFEYVSQPFLMDLEGKQGNFKNLREFVFKNIDGYFKIYSKHTPINLGRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFDEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVAGVNCYFPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRSSANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 50 - protein, 1270 aa, synthetic construct
MFVFLVLLPLVSSQCVNLITRTQSYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYYHENNKSRMESELRVYSSANNCTFEYVSQPFLMDLEGKQGNFKNLREFVFKNIDGYFKIYSKHTPVNLGRDLPQGFSALEPLVDLPIGINITRFQTLLALHRSYLTPGDSSSSWTAGAAAYYVGYLQPRTFLLKYNENGTITDAVDCALDPLSETKCTLKSFTVEKGIYQTSNFRVQPTESIVRFPNITNLCPFHEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVSGNYNYLYRLFRKSKLKPFERDISTEIYQAGNKPCNGVAGFNCYFPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 51 - protein, 1270 aa, synthetic construct
MFVFLVLLPLVSSQCVNLITRTQSYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYYHENNKSRMESELRVYSSANNCTFEYVSQPFLMDLEGKQGNFKNLREFVFKNIDGYFKIYSKHTPVNLGRDLPQGFSALEPLVDLPIGINITRFQTLLALHRSYLTPGDSSSSWTAGAAAYYVGYLQPRTFLLKYNENGTITDAVDCALDPLSETKCTLKSFTVEKGIYQTSNFRVQPTESIVRFPNITNLCPFHEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVSGNYNYLYRLFRKSKLKPFERDISTEIYQAGNKPCNGVAGFNCYFPLQSYGFRPTYGVGHQPYRVVVLSFELLHAPATVCGPKKSTNLVKNKCVNFNFNGLTGTGVLTESNKKFLPFQQFGRDIADTTVAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 52 - protein, 1270 aa, synthetic construct
MFVFLVLLPLVSSQCVNLITRTQSYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYYHENNKSRMESELRVYSSANNCTFEYVSQPFLMDLEGKQGNFKNLREFVFKNIDGYFKIYSKHTPVNLGRDLPQGFSALEPLVDLPIGINITRFQTLLALHRSYLTPGDSSSSWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVSGNYNYLYRLFRKSKLKPFERDISTEIYQAGNKPCNGVAGSNCYFPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLINLQELGKYEQYIKWPWYIWLGFIAGLIAIVMVTIMLCCMTSCCSCLKGCCSCGSCCKFDEDDSEPVLKGVKLHYT

SEQ ID NO: 53 - protein, 1270 aa, synthetic construct
MFVFLVLLPLVSSQCVNLITRTQSYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYYHENNKSRMESELRVYSSANNCTFEYVSQPFLMDLEGKQGNFKNLREFVFKNIDGYFKIYSKHTPVNLGRDLPQGFSALEPLVDLPIGINITRFQTLLALHRSYLTPGDSSSSWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVSGNYNYRYRLFRKSKLKPFERDISTEIYQAGNKPCNGVAGSNCYFPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNISNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLINLQELGKYEQYIKWPWYIWLGFIAGLIAIVMVTIMLCCMTSCCSCLKGCCSCGSCCKFDEDDSEPVLKGVKLHYT

SEQ ID NO: 54 - protein, 1270 aa, synthetic construct
MFVFLVLLPLVSSQCVNLITRTQSYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYYHENNKSRMESELRVYSSANNCTFEYVSQPFLMDLEGKQGNFKNLREFVFKNIDGYFKIYSKHTPVNLGRDLPQGFSALEPLVDLPIGINITRFQTLLALHRSYLTPGDSSSSWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVSGNYNYLYRLFRKSKLKPFERDISTEIYQAGNKPCNGVAGSNCYFPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 55 - protein, 1270 aa, synthetic construct
MFVFLVLLPLVSSQCVNLITRTQSYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYYHENNKSRMESELRVYSSANNCTFEYVSQPFLMDLEGKQGNFKNLREFVFKNIDGYFKIYSKHTPVNLGRDLPQGFSALEPLVDLPIGINITRFQTLLALHRSYLTPGDSSSSWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVSGNYNYLYRLFRKSKLKPFERDISTEIYQAGNKPCNGVAGSNCYSPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 56 - protein, 1273 aa, synthetic construct
MFVFLVLLPLVSSQCVNLTTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 57 - protein, 1270 aa, synthetic construct
MFVFLVLLPLVSSQCVNLTTRTQLPPAYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLGVYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGSTPCNGVEGFNCYFPLQSYGFQPTYGVGYQPYRVVVLSFELLHAPATVCGPKKSTNLVKNKCVNFNFNGLTGTGVLTESNKKFLPFQQFGRDIDDTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSHRRARSVASQSIIAYTMSLGAENSVAYSNNSIAIPINFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILARLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTHNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 58 - protein, 1270 aa, synthetic construct
MFVFLVLLPLVSSQCVNFTTRTQLPPAYTNSFTRGVYYPDKVFRSSVLHSTQDLFLPFFSNVTWFHAIHVSGTNGTKRFANPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRGLPQGFSALEPLVDLPIGINITRFQTLHISYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGNIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGVENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 59 - protein, 1273 aa, synthetic construct
MFVFLVLLPLVSSQCVNFTNRTQLPSAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNYPFLGVYYHKNNKSWMESEFRVYSSANNCTFEYVSQPFLMDLEGKQGNFKNLSEFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGTIADYNYKLPDDFTGCVIAWNSNNLDSKVGGNYNYLYRLFRKSNLKPFERDISTEIYQAGSTPCNGVKGFNCYFPLQSYGFQPTYGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAAIKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 60 - protein, 1271 aa, synthetic construct
MFVFLVLLPLVSSQCVNLRTRTQLPPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLGVYYHKNNKSWMESEVYSSANNCTFEYVSQPFLMDLEGKQGNFKNLREFVFKNIDGYFKIYSKHTPINLVRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYRYRLFRKSNLKPFERDISTEIYQAGSKPCNGVEGFNCYFPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSRRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQNVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 61 - protein, 1266 aa, synthetic construct
MFVFLVLLPLVSSQCVNLTTRTQLPPAYTNSFTRGVYYPDKVFRSSVLHSTQDLFLPFFSNVTWFHAIHVSGTNVIKRFDNPVLPFNDGVYFASTEKSNIIRGWIFGTTLDSKTQSLLIVNNATNVVIKVCEFQFCNDPFLGVYYHKNNKSWMESEFRVYSSANNCTFEYVSQPFLMDLEGKQGNFKNLREFVFKNIDGYFKIYSKHTPINLVRDLPQGFSALEPLVDLPIGINITRFQTLLALHDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNSASFSTFKCYGVSPTKLNDLCFTNVYADSFVIRGDEVRQIAPGQTGKIADYNYKLPDDFTGCVIAWNSNNLDSKVGGNYNYQYRLFRKSNLKPFERDISTEIYQAGSTPCNGVEGFNCYSPLQSYGFQPTNGVGYQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEHVNNSYECDIPIGAGICASYQTQTNSPRRARSVASQSIIAYTMSLGAENSVAYSNNSIAIPTNFTISVTTEILPVSMTKTSVDCTMYICGDSTECSNLLLQYGSFCTQLNRALTGIAVEQDKNTQEVFAQVKQIYKTPPIKDFGGFNFSQILPDPSKPSKRSFIEDLLFNKVTLADAGFIKQYGDCLGDIAARDLICAQKFNGLNVLPPLLTDEMIAQYTSALLAGTITSGWTFGAGAALQIPFAMQMAYRFNGIGVTQNVLYENQKLIANQFNSAIGKIQDSLSSTASALGKLQDVVNQNAQALNTLVKQLSSNFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 62 - protein, 1270 aa, synthetic construct
MFVFLVLLPLVSSQCVNLTTRTQLPPAYTNSFTRGVYYPDKVFRSSVLHSTQDLFLPFFSNVTWFHVISGTNGTKRFDNPVLPFNDGVYFASIEKSNIIRGWIFGTTLDSKTQSLLIVNNATNVVIKVCEFQFCNDPFLDHKNNKSWMESEFRVYSSANNCTFEYVSQPFLMDLEGKQGNFKNLREFVFKNIDGYFKIYSKHTPIIVREPEDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFDEVFNATRFASVYAWNRKRISNCVADYSVLYNLAPFFTFKCYGVSPTKLNDLCFTNVYADSFVIRGDEVRQIAPGQTGNIADYNYKLPDDFTGCVIAWNSNKLDSKVSGNYNYLYRLFRKSNLKPFERDISTEIYQAGNKPCNGVAGFNCYFPLRSYSFRPTYGVGHQPYRVVVLSFELLHAPATVCGPKKSTNLVKNKCVNFNFNGLKGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFKGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDIFSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 63 - protein, 1270 aa, synthetic construct
MFVFLVLLPLVSSQCVNLTTRTQLPPAYTNSFTRGVYYPDKVFRSSVLHSTQDLFLPFFSNVTWFHVISGTNGTKRFDNPVLPFNDGVYFASIEKSNIIRGWIFGTTLDSKTQSLLIVNNATNVVIKVCEFQFCNDPFLDHKNNKSWMESEFRVYSSANNCTFEYVSQPFLMDLEGKQGNFKNLREFVFKNIDGYFKIYSKHTPIIVREPEDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFDEVFNATRFASVYAWNRKRISNCVADYSVLYNLAPFFTFKCYGVSPTKLNDLCFTNVYADSFVIRGDEVRQIAPGQTGKIADYNYKLPDDFTGCVIAWNSNNLDSKVGGNYNYLYRLFRKSNLKPFERDISTEIYQAGNKPCNGVAGFNCYFPLRSYSFRPTYGVGHQPYRVVVLSFELLHAPATVCGPKKSTNLVKNKCVNFNFNGLKGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFKGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDIFSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 64 - protein, 1270 aa, synthetic construct
MFVFLVLLPLVSSQCVNLITRTQSYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYYHKNNKSWMESEFRVYSSANNCTFEYVSQPFLMDLEGKQGNFKNLREFVFKNIDGYFKIYSKHTPINLGRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFDEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVGGNYNYLYRLFRKSNLKPFERDISTEIYQAGNKPCNGVAGFNCYFPLRSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 65 - protein, 1268 aa, synthetic construct
MFVFLVLLPLVSSQCVNLITRTQSYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLDVYYHKNNKSWMESEFRVYSSANNCTFEYVSQPFLMDLEGKQGNFKNLREFVFKNIDGYFKIYSKHTPINLGRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFDEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVAGVNCYFPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNSSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 66 - protein, 1268 aa, synthetic construct
MFVFLVLLPLVSSQCVNLITRTQSYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLDVYYHKNNKSWMESEFRVYSSANNCTFEYVSQPFLMDLEGKQGNFKNLREFVFKNIDGYFKIYSKHTPINLGRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFDEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVAGVNCYFPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 67 - protein, 1268 aa, synthetic construct
MFVFLVLLPLVSSQCVNLITRTQSYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLDVYYHKNNKSWMESEFRVYSSANNCTFEYVSQPFLMDLEGKQGNFKNLREFVFKNIDGYFKIYSKHTPINLGRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFDEVFNATRFASVYAWNRKRISNCVADYSVLYNFAPFFAFKCYGVSPTKLNDLCFTNVYADSFVIRGNEVRQIAPGQTGNIADYNYKLPDDFTGCVIAWNSNKLDSKVGGNYNYRYRLFRKSNLKPFERDISTEIYQAGNKPCNGVAGVNCYFPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 68 - RNA, 3822 nt, Severe acute respiratory syndrome coronavirus 2
  source 1..3822: mol_type = mRNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgacaaagttgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 69 - RNA, 3822 nt, synthetic construct
  source 1..3822: mol_type = other RNA
atgtttgtttttcttgttttattgccactagtctctagtcagtgtgttaatcttacaaccagaactcaattaccccctgcatacactaattctttcacacgtggtgtttattaccctgacaaagttttcagatcctcagttttacattcaactcaggacttgttcttacctttcttttccaatgttacttggttccatgctatacatgtctctgggaccaatggtactaagaggtttgataaccctgtcctaccatttaatgatggtgtttattttgcttccactgagaagtctaacataataagaggctggatttttggtactactttagattcgaagacccagtccctacttattgttaataacgctactaatgttgttattaaagtctgtgaatttcaattttgtaatgatccatttttgggtgtttattaccacaaaaacaacaaaagttggatggaaagtgagttcagagtttattctagtgcgaataattgcacttttgaatatgtctctcagccttttcttatggaccttgaaggaaaacagggtaatttcaaaaatcttagggaatttgtgtttaagaatattgatggttattttaaaatatattctaagcacacgcctattaatttagtgcgtgatctccctcagggtttttcggctttagaaccattggtagatttgccaataggtattaacatcactaggtttcaaactttacttgctttacatagaagttatttgactcctggtgattcttcttcaggttggacagctggtgctgcagcttattatgtgggttatcttcaacctaggacttttctattaaaatataatgaaaatggaaccattacagatgctgtagactgtgcacttgaccctctctcagaaacaaagtgtacgttgaaatccttcactgtagaaaaaggaatctatcaaacttctaactttagagtccaaccaacagaatctattgttagatttcctaatattacaaacttgtgcccttttggtgaagtttttaacgccaccagatttgcatctgtttatgcttggaacaggaagagaatcagcaactgtgttgctgattattctgtcctatataattccgcatcattttccacttttaagtgttatggagtgtctcctactaaattaaatgatctctgctttactaatgtctatgcagattcatttgtaattagaggtgatgaagtcagacaaatcgctccagggcaaactggaaagattgctgattataattataaattaccagatgattttacaggctgcgttatagcttggaattctaacaatcttgattctaaggttggtggtaattataattacctgtatagattgtttaggaagtctaatctcaaaccttttgagagagatatttcaactgaaatctatcaggccggtagcacaccttgtaatggtgttgaaggttttaattgttactttcctttacaatcatatggtttccaacccactaatggtgttggttaccaaccatacagagtagtagtactttcttttgaacttctacatgcaccagcaactgtttgtggacctaaaaagtctactaatttggttaaaaacaaatgtgtcaatttcaacttcaatggtttaacaggcacaggtgttcttactgagtctaacaaaaagtttctgcctttccaacaatttggcagagacattgctgacactactgatgctgtccgtgatccacagacacttgagattcttgacattacaccatgttcttttggtggtgtcagtgttataacaccaggaacaaatacttctaaccaggttgctgttctttatcaggatgttaactgcacagaagtccctgttgctattcatgcagatcaacttactcctacttggcgtgtttattctacaggttctaatgtttttcaaacacgtgcaggctgtttaataggggctgaacatgtcaacaactcatatgagtgtgacatacccattggtgcaggtatatgcgctagttatcagactcagactaattctcctcggcgggcacgtagtgtagctagtcaatccatcattgcctacactatgtcacttggtgcagaaaattcagttgcttactctaataactctattgccatacccacaaattttactattagtgttaccacagaaattctaccagtgtctatgaccaagacatcagtagattgtacaatgtacatttgtggtgattcaactgaatgcagcaatcttttgttgcaatatggcagtttttgtacacaattaaaccgtgctttaactggaatagctgttgaacaagacaaaaacacccaagaagtttttgcacaagtcaaacaaatttacaaaacaccaccaattaaagattttggtggttttaatttttcacaaatattaccagatccatcaaaaccaagcaagaggtcatttattgaagatctacttttcaacaaagtgacacttgcagatgctggcttcatcaaacaatatggtgattgccttggtgatattgctgctagagacctcatttgtgcacaaaagtttaacggccttactgttttgccacctttgctcacagatgaaatgattgctcaatacacttctgcactgttagcgggtacaatcacttctggttggacctttggtgcaggtgctgcattacaaataccatttgctatgcaaatggcttataggtttaatggtattggagttacacagaatgttctctatgagaaccaaaaattgattgccaaccaatttaatagtgctattggcaaaattcaagactcactttcttccacagcaagtgcacttggaaaacttcaagatgtggtcaaccaaaatgcacaagctttaaacacgcttgttaaacaacttagctccaattttggtgcaatttcaagtgttttaaatgatatcctttcacgtcttgaccctcctgaggctgaagtgcaaattgataggttgatcacaggcagacttcaaagtttgcagacatatgtgactcaacaattaattagagctgcagaaatcagagcttctgctaatcttgctgctactaaaatgtcagagtgtgtacttggacaatcaaaaagagttgatttttgtggaaagggctatcatcttatgtccttccctcagtcagcacctcatggtgtagtcttcttgcatgtgacttatgtccctgcacaagaaaagaacttcacaactgctcctgccatttgtcatgatggaaaagcacactttcctcgtgaaggtgtctttgtttcaaatggcacacactggtttgtaacacaaaggaatttttatgaaccacaaatcattactacagacaacacatttgtgtctggtaactgtgatgttgtaataggaattgtcaacaacacagtttatgatcctttgcaacctgaattagactcattcaaggaggagttagataaatattttaagaatcatacatcaccagatgttgatttaggtgacatctctggcattaatgcttcagttgtaaacattcaaaaagaaattgaccgcctcaatgaggttgccaagaatttaaatgaatctctcatcgatctccaagaacttggaaagtatgagcagtatataaaatggccatggtacatttggctaggttttatagctggcttgattgccatagtaatggtgacaattatgctttgctgtatgaccagttgctgtagttgtctcaagggctgttgttcttgtggatcctgctgcaaatttgatgaagacgactctgagccagtgctcaaaggagtcaaattacattacacataa

SEQ ID NO: 70 - RNA, 3810 nt, synthetic construct
  source 1..3810: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggcagcaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 71 - RNA, 3810 nt, synthetic construct
  source 1..3810: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaacctcaagcccttcgagcgggacatctccaccgagatctaccaggccggcaacaagccctgcaacggggccgccggcttcaactgctacgtgcccctgcgctcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcgacgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagatcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 72 - RNA, 3807 nt, synthetic construct
  source 1..3807: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaccgtcgggggcaactacaactaccgctaccgcctgttccgcaagagcaagctcaagcccttcgagcgggacatctccaccgagatctaccaggccggcaacaagccctgcaacggggtggccggcgtgaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 73 - RNA, 3804 nt, synthetic construct
  source 1..3804: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccacccggttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccatggtcgggggcaactacaactaccgctaccgcctgttccgcaagagcaagctcaagcccttcgagcgggacatctccaccgagatctaccaggccggcaacaagccctgcaacggggtggccggcgtgaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 74 - RNA, 3807 nt, synthetic construct
  source 1..3807: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccacccggttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcgggggcaactacaactaccgctaccgcctgttccgcaagagcaacctcaagcccttcgagcgggacatctccaccgagatctaccaggccggcaacaagccctgcaacggggtggccggcgtgaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcagcagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 75 - RNA, 3813 nt, synthetic construct
  source 1..3813: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacgagaacaacaagagccgcatggagtccgagctgcgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccggtgaacctgggccgggacctgccccaggggttcagcgccctcgagcccctggtggacctgcccatcggcatcaacatcacccgcttccagaccctcctggccctgcaccggtcctacctcacgccgggggacagcagctccagctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccacccggttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcagcggcaactacaactacctgtaccgcctgttccgcaagagcaagctcaagcccttcgagcgggacatctccaccgagatctaccaggccggcaacaagccctgcaacggggtggccggcttcaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 76 - RNA, 3813 nt, synthetic construct
  source 1..3813: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacgagaacaacaagagccgcatggagtccgagctgcgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccggtgaacctgggccgggacctgccccaggggttcagcgccctcgagcccctggtggacctgcccatcggcatcaacatcacccgcttccagaccctcctggccctgcaccggtcctacctcacgccgggggacagcagctccagctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccacccggttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcagcggcaactacaactacctgtaccgcctgttccgcaagagcaagctcaagcccttcgagcgggacatctccaccgagatctaccaggccggcaacaagccctgcaacggggtggccggcttcaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgtggcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 77 - RNA, 3813 nt, synthetic construct
  source 1..3813: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacgagaacaacaagagccgcatggagtccgagctgcgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccggtgaacctgggccgggacctgccccaggggttcagcgccctcgagcccctggtggacctgcccatcggcatcaacatcacccgcttccagaccctcctggccctgcaccggtcctacctcacgccgggggacagcagctccagctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcagcggcaactacaactacctgtaccgcctgttccgcaagagcaagctcaagcccttcgagcgggacatctccaccgagatctaccaggccggcaacaagccctgcaacggggtggccggcagcaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcaacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 78 - RNA, 3813 nt, synthetic construct
  source 1..3813: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacgagaacaacaagagccgcatggagtccgagctgcgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccggtgaacctgggccgggacctgccccaggggttcagcgccctcgagcccctggtggacctgcccatcggcatcaacatcacccgcttccagaccctcctggccctgcaccggtcctacctcacgccgggggacagcagctccagctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcagcggcaactacaactaccgctaccgcctgttccgcaagagcaagctcaagcccttcgagcgggacatctccaccgagatctaccaggccggcaacaagccctgcaacggggtggccggcagcaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacatcagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcaacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 79 - RNA, 3813 nt, synthetic construct
  source 1..3813: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacgagaacaacaagagccgcatggagtccgagctgcgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccggtgaacctgggccgggacctgccccaggggttcagcgccctcgagcccctggtggacctgcccatcggcatcaacatcacccgcttccagaccctcctggccctgcaccggtcctacctcacgccgggggacagcagctccagctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcagcggcaactacaactacctgtaccgcctgttccgcaagagcaagctcaagcccttcgagcgggacatctccaccgagatctaccaggccggcaacaagccctgcaacggggtggccggcagcaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 80 - RNA, 3813 nt, synthetic construct
  source 1..3813: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacgagaacaacaagagccgcatggagtccgagctgcgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccggtgaacctgggccgggacctgccccaggggttcagcgccctcgagcccctggtggacctgcccatcggcatcaacatcacccgcttccagaccctcctggccctgcaccggtcctacctcacgccgggggacagcagctccagctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcagcggcaactacaactacctgtaccgcctgttccgcaagagcaagctcaagcccttcgagcgggacatctccaccgagatctaccaggccggcaacaagccctgcaacggggtggccggcagcaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 81 - RNA, 3822 nt, synthetic construct
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 82 - RNA, 3822 nt, synthetic construct
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 83 - RNA, 3822 nt, synthetic construct
  source 1..3822: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 84 - RNA, 3813 nt, synthetic construct
  source 1..3813: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgacgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactcccaccggcgcgcccggagcgtggcgtcccagagcatcatcgcctacaccatgtccctgggcgccgagaacagcgtcgcctactccaacaacagcatcgccatccccatcaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctcgcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccacccacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 85 - RNA, 3813 nt, synthetic construct
  source 1..3813: mol_type = other RNA
atgttcgtgttcctggtcctcctgcccctggtgagctcccagtgcgtgaacttcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgccaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccggggcctgccccaggggttcagcgccctcgagcccctggtggacctgcccatcggcatcaacatcacccgcttccagaccctccacatctcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgtggagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 86 - RNA, 3822 nt, synthetic construct
  source 1..3822: mol_type = other RNA
atgttcgtgttcctggtcctcctgcccctggtgagctcccagtgcgtgaacttcaccaaccgcacgcagctgccgagcgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaactaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctcagcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaccatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgatcaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 87 - RNA, 3816 nt, synthetic construct
  source 1..3816: mol_type = other RNA
atgttcgtgttcctggtcctcctgcccctggtgagctcccagtgcgtgaacctccgcacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgaggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactaccgctaccgcctgttccgcaagagcaacctcaagcccttcgagcgggacatctccaccgagatctaccaggccggcagcaagccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactcccgccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcagaacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 88 - RNA, 3801 nt, synthetic construct
  source 1..3801: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacgtgatcaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcacgacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactaccagtaccgcctgttccgcaagagcaacctcaagcccttcgagcgggacatctccaccgagatctaccaggccggcagcaccccctgcaacggggtggagggcttcaactgctacagccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaacgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 89 - RNA, 3813 nt, synthetic construct
  source 1..3813: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgtgatctccgggaccaacggcaccaagcggttcgacaacccggtgctgcccttcaacgacggggtctacttcgcgagcatcgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcatcgtccgggagcccgaggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccacccggttcgccagcgtctacgcctggaaccgcaagcggatctccaactgcgtggcggactacagcgtgctgtacaacctggcccccttcttcacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaagctcgactccaaggtcagcggcaactacaactacctgtaccgcctgttccgcaagagcaacctcaagcccttcgagcgggacatctccaccgagatctaccaggccggcaacaagccctgcaacggggtggccggcttcaactgctacttccccctgcgctcctacagcttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaaggggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaagggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcttctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 90 - RNA, 3813 nt, synthetic construct
  source 1..3813: mol_type = other RNA
atgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgtgatctccgggaccaacggcaccaagcggttcgacaacccggtgctgcccttcaacgacggggtctacttcgcgagcatcgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcatcgtccgggagcccgaggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccacccggttcgccagcgtctacgcctggaaccgcaagcggatctccaactgcgtggcggactacagcgtgctgtacaacctggcccccttcttcacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaagccctgcaacggggtggccggcttcaactgctacttccccctgcgctcctacagcttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaaggggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaagggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcttctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 91 - RNA, 3813 nt, synthetic construct
  source 1..3813: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccacccggttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcgggggcaactacaactacctgtaccgcctgttccgcaagagcaacctcaagcccttcgagcgggacatctccaccgagatctaccaggccggcaacaagccctgcaacggggtggccggcttcaactgctacttccccctgcgctcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 92 - RNA, 3807 nt, synthetic construct
  source 1..3807: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccacccggttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcgggggcaactacaactaccgctaccgcctgttccgcaagagcaacctcaagcccttcgagcgggacatctccaccgagatctaccaggccggcaacaagccctgcaacggggtggccggcgtgaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacagctcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 93 - RNA, 3807 nt, synthetic construct
  source 1..3807: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccacccggttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcgggggcaactacaactaccgctaccgcctgttccgcaagagcaacctcaagcccttcgagcgggacatctccaccgagatctaccaggccggcaacaagccctgcaacggggtggccggcgtgaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 94 - RNA, 3807 nt, synthetic construct
  source 1..3807: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccacccggttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtccggcagatcgcccccggccagaccgggaacatcgccgactacaactacaagctgccggacgacttcacgggctgcgtgatcgcgtggaacagcaacaagctcgactccaaggtcgggggcaactacaactaccgctaccgcctgttccgcaagagcaacctcaagcccttcgagcgggacatctccaccgagatctaccaggccggcaacaagccctgcaacggggtggccggcgtgaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 95 - RNA, 3822 nt, synthetic construct
  source 1..3822: mol_type = other RNA
atgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccaggacgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 96 - RNA, 3813 nt, synthetic construct
  source 1..3813: mol_type = other RNA
atgttcgtgttcctggtgctgctgcccctggtgagcagccagtgcgtgaactttaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgccaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcggggcctgccccagggcttctcagccctggagcccctggtggacctgcccatcggcatcaacatcacccggttccagaccctgcacatcagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaacatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtgaagggcttcaactgctacttccctctgcagagctacggcttccagcccacctacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgtggagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 97 - RNA, 3813 nt, synthetic construct
  source 1..3813: mol_type = other RNA
atgttcgtgttcctggtgctgctgcccctggtgagcagccagtgcgtgaacctgaccacccggacccagctgccaccagcctacaccaacagcttcacccggggcgtgtactaccccgacaaggtgttccggagcagcgtgctgcacagcacccaggacctgttcctgcccttcttcagcaacgtgacctggttccacgtgatcagcggcaccaacggcaccaagcggttcgacaaccccgtgctgcccttcaacgacggcgtgtacttcgccagcatcgagaagagcaacatcatccggggctggatcttcggcaccaccctggacagcaagacccagagcctgctgatcgtgaacaacgccaccaacgtggtgatcaaggtgtgcgagttccagttctgcaacgaccccttcctggaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcatcgtgcgggagcccgaggacctgccccagggcttcagcgccctggagcccctggtggacctgcccatcggcatcaacatcacccggttccagaccctgctggccctgcaccggagctacctgaccccaggcgacagcagcagcggctggaccgccggcgccgccgcctactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcgacgaggtgttcaacgccacccggttcgccagcgtgtacgcctggaaccggaagcggatcagcaactgcgtggccgactacagcgtgctgtacaacctggcccctttcttcaccttcaagtgctacggcgtgagccccaccaagctgaacgacctgtgcttcaccaacgtgtacgccgacagcttcgtgatccggggcgacgaggtgcggcagatcgccccaggccagaccggcaacatcgccgactacaactacaagctgcccgacgacttcaccggctgcgtgatcgcctggaacagcaacaagctggacagcaaggtgagcggcaactacaactacctgtaccggctgttccggaagagcaacctgaagcccttcgagcgggacatcagcaccgagatctaccaggccggcaacaagccctgcaacggcgtggccggcttcaactgctacttccctctgcggagctacagcttccggcccacctacggcgtgggccaccagccctaccgggtggtggtgctgagcttcgagctgctgcacgccccagccaccgtgtgcggccccaagaagagcaccaacctggtgaagaacaagtgcgtgaacttcaacttcaacggcctgaagggcaccggcgtgctgaccgagagcaacaagaagttcctgcccttccagcagttcggccgggacatcgccgacaccaccgacgccgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgaccccaacctggcgggtgtacagcaccggcagcaacgtgttccagacccgggccggctgcctgatcggcgccgagtacgtgaacaacagctacgagtgcgacatccccatcggcgccggcatctgcgccagctaccagacccagaccaagagccaccggcgggcccggagcgtggccagccagagcatcatcgcctacaccatgagcctgggcgccgagaacagcgtggcctacagcaacaacagcatcgccatccccaccaacttcaccatcagcgtgaccaccgagatcctgcccgtgagcatgaccaagaccagcgtggactgcaccatgtacatctgcggcgacagcaccgagtgcagcaacctgctgctgcagtacggcagcttctgcacccagctgaagcgggccctgaccggcatcgccgtggagcaggacaagaacacccaggaggtgttcgcccaggtgaagcagatctacaagacccctcccatcaagtacttcggcggcttcaacttcagccagatcctgcccgaccccagcaagcccagcaagcggagcttcatcgaggacctgctgttcaacaaggtgaccctggccgacgccggcttcatcaagcagtacggcgactgcctgggcgacatcgccgcccgggacctgatctgcgcccagaagttcaagggcctgaccgtgctgcctcctctgctgaccgacgagatgatcgcccagtacaccagcgccctgctggccggcaccatcaccagcggctggaccttcggcgccggcgccgccctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgccagcgccctgggcaagctgcaggacgtggtgaaccacaacgcccaggccctgaacaccctggtgaagcagctgagcagcaagttcggcgccatcagcagcgtgctgaacgacatcttcagccggctggaccctcccgaggccgaggtgcagatcgaccggctgatcaccggccggctgcagagcctgcagacctacgtgacccagcagctgatccgggccgccgagatccgggccagcgccaacctggccgccaccaagatgagcgagtgcgtgctgggccagagcaagcgggtggacttctgcggcaagggctaccacctgatgagctttccccagagcgcaccccacggcgtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaaccacaccagccccgacgtggacctgggcgacatcagcggcatcaacgccagcgtggtgaacatccagaaggagatcgacagactgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgctgcagctgcggcagctgctgcaagttcgacgaggacgacagcgagcccgtgctgaagggcgtgaagctgcactacacctga

SEQ ID NO: 98 - RNA, 3807 nt, synthetic construct
  source 1..3807: mol_type = other RNA
atgttcgtgttcctggtgctgctgcccctggtgagcagccagtgcgtgaacctgatcacccggacccagagctacaccaacagcttcacccggggcgtctactaccccgacaaggtgttccggagcagcgtcctgcacagcacccaggacctgttcctgcccttcttcagcaacgtgacctggttccacgccatcagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctggacgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctgggccgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcgacgaggtgttcaacgccacccggttcgccagcgtgtacgcctggaaccggaagcggatcagcaactgcgtggccgactacagcgtgctgtacaacttcgccccattcttcgccttcaagtgctacggcgtgagccccaccaagctgaacgacctgtgcttcaccaacgtgtacgccgacagcttcgtgatccgtggcaacgaggtgagccagatcgcacccggccagacaggcaacatcgccgactacaactacaagctgcccgacgacttcaccggctgcgtgatcgcctggaacagcaacaagctcgacagcaaggtgggcggcaactacaactaccggtaccggctgttccggaagagcaacctgaagcccttcgagcgggacatcagcaccgagatctaccaagccggcaacaagccttgcaacggcgtggccggcgtgaactgctacttccctctgcagagctacggcttccggcccacctacggcgtgggccaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggtgtgaactgcaccgaggtgcccgtggccatccacgccgaccagctgacacccacctggcgggtctacagcaccggcagcaacgtgttccagacccgggccggttgcctgatcggcgccgagtacgtgaacaacagctacgagtgcgacatccccatcggcgccggcatctgtgccagctaccagacccagaccaagtcacaccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaagcgggccctgaccggcatcgccgtggagcaggacaagaacacccaggaggtgttcgcccaggtgaagcagatctacaagacccctcccatcaagtacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccacaacgcccaggccctgaacaccctggtgaagcagctgagcagcaagttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 99 - RNA, 3822 nt, synthetic construct
  source 1..3822: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 100 - RNA, 3813 nt, synthetic construct
  source 1..3813: mol_type = other RNA
atgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgtgatctccggcaccaatggcaccaagagattcgacaaccccgtgctgcccttcaacgacggggtgtactttgccagcatcgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctggaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcatcgtgagagagcccgaggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcgacgaggtgttcaatgccaccagattcgcctctgtgtacgcctggaaccggaagcggatcagcaattgcgtggccgactactccgtgctgtacaacctggcccccttcttcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaagctggactccaaagtcagcggcaactacaattacctgtaccggctgttccggaagtccaatctgaagcccttcgagcgggacatctccaccgagatctatcaggccggcaacaagccttgtaacggcgtggccggcttcaactgctacttcccactgcggtcctacagctttaggcccacatacggcgtgggccaccagccctacagagtggtggtgctgagcttcgaactgctgcatgcccctgccacagtgtgcggccctaagaaaagcaccaatctcgtgaagaacaaatgcgtgaacttcaacttcaacggcctgaagggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaagagccaccggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaaaagagccctgacagggatcgccgtggaacaggacaagaacacccaagaggtgttcgcccaagtgaagcagatctacaagacccctcctatcaagtacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaagggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccacaatgcccaggcactgaacaccctggtcaagcagctgtcctccaagttcggcgccatcagctctgtgctgaacgatatcttcagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 101 - RNA, 3807 nt, synthetic construct
  source 1..3807: mol_type = other RNA
atgttcgtgttcctggtgctgctgcctctggtgtccagccagtgtgtgaacctgatcaccagaacacagtcatacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctggacgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcggccgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcgacgaggtgttcaatgccaccagattcgcctctgtgtacgcctggaaccggaagcggatcagcaattgcgtggccgactactccgtgctgtacaacttcgcccccttcttcgcattcaagtgctacggcgtgtcccctaccaagctgaacgacctgtgcttcacaaacgtgtacgccgacagcttcgtgatccggggaaacgaagtgcggcagattgcccctggacagacaggcaacatcgccgactacaactacaagctgcccgacgacttcaccggctgtgtgattgcctggaacagcaacaagctggactccaaagtcggcggcaactacaattacaggtaccggctgttccggaagtccaatctgaagcccttcgagcgggacatctccaccgagatctatcaggccggcaacaagccttgtaacggcgtggcaggcgtgaactgctacttcccactgcagtcctacggctttaggcccacatacggcgtgggccaccagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaagagccaccggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaaaagagccctgacagggatcgccgtggaacaggacaagaacacccaagaggtgttcgcccaagtgaagcagatctacaagacccctcctatcaagtacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccacaatgcccaggcactgaacaccctggtcaagcagctgtcctccaagttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 102 - RNA, 4088 nt, synthetic construct
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggcagcaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 103 - RNA, 4088 nt, synthetic construct
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaacctcaagcccttcgagcgggacatctccaccgagatctaccaggccggcaacaagccctgcaacggggccgccggcttcaactgctacgtgcccctgcgctcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcgacgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagatcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 104 - RNA, 4085 nt, synthetic construct
  source 1..4085: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaccgtcgggggcaactacaactaccgctaccgcctgttccgcaagagcaagctcaagcccttcgagcgggacatctccaccgagatctaccaggccggcaacaagccctgcaacggggtggccggcgtgaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 105 - RNA, 4082 nt, synthetic construct
  source 1..4082: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccacccggttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccatggtcgggggcaactacaactaccgctaccgcctgttccgcaagagcaagctcaagcccttcgagcgggacatctccaccgagatctaccaggccggcaacaagccctgcaacggggtggccggcgtgaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 106 - RNA, 4085 nt, synthetic construct
  source 1..4085: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccacccggttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcgggggcaactacaactaccgctaccgcctgttccgcaagagcaacctcaagcccttcgagcgggacatctccaccgagatctaccaggccggcaacaagccctgcaacggggtggccggcgtgaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcagcagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 107 - RNA, 4091 nt, synthetic construct
  source 1..4091: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacgagaacaacaagagccgcatggagtccgagctgcgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccggtgaacctgggccgggacctgccccaggggttcagcgccctcgagcccctggtggacctgcccatcggcatcaacatcacccgcttccagaccctcctggccctgcaccggtcctacctcacgccgggggacagcagctccagctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccacccggttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcagcggcaactacaactacctgtaccgcctgttccgcaagagcaagctcaagcccttcgagcgggacatctccaccgagatctaccaggccggcaacaagccctgcaacggggtggccggcttcaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 108 - RNA, 4091 nt, synthetic construct
  source 1..4091: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacgagaacaacaagagccgcatggagtccgagctgcgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccggtgaacctgggccgggacctgccccaggggttcagcgccctcgagcccctggtggacctgcccatcggcatcaacatcacccgcttccagaccctcctggccctgcaccggtcctacctcacgccgggggacagcagctccagctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccacccggttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcagcggcaactacaactacctgtaccgcctgttccgcaagagcaagctcaagcccttcgagcgggacatctccaccgagatctaccaggccggcaacaagccctgcaacggggtggccggcttcaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgtggcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 109 - RNA, 4091 nt, synthetic construct
  source 1..4091: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacgagaacaacaagagccgcatggagtccgagctgcgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccggtgaacctgggccgggacctgccccaggggttcagcgccctcgagcccctggtggacctgcccatcggcatcaacatcacccgcttccagaccctcctggccctgcaccggtcctacctcacgccgggggacagcagctccagctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcagcggcaactacaactacctgtaccgcctgttccgcaagagcaagctcaagcccttcgagcgggacatctccaccgagatctaccaggccggcaacaagccctgcaacggggtggccggcagcaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcaacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 110 - RNA, 4091 nt, synthetic construct
  source 1..4091: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacgagaacaacaagagccgcatggagtccgagctgcgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccggtgaacctgggccgggacctgccccaggggttcagcgccctcgagcccctggtggacctgcccatcggcatcaacatcacccgcttccagaccctcctggccctgcaccggtcctacctcacgccgggggacagcagctccagctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcagcggcaactacaactaccgctaccgcctgttccgcaagagcaagctcaagcccttcgagcgggacatctccaccgagatctaccaggccggcaacaagccctgcaacggggtggccggcagcaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacatcagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcaacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 111 - RNA, 4091 nt, synthetic construct
  source 1..4091: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacgagaacaacaagagccgcatggagtccgagctgcgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccggtgaacctgggccgggacctgccccaggggttcagcgccctcgagcccctggtggacctgcccatcggcatcaacatcacccgcttccagaccctcctggccctgcaccggtcctacctcacgccgggggacagcagctccagctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcagcggcaactacaactacctgtaccgcctgttccgcaagagcaagctcaagcccttcgagcgggacatctccaccgagatctaccaggccggcaacaagccctgcaacggggtggccggcagcaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 112 - RNA, 4091 nt, synthetic construct
  source 1..4091: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacgagaacaacaagagccgcatggagtccgagctgcgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccggtgaacctgggccgggacctgccccaggggttcagcgccctcgagcccctggtggacctgcccatcggcatcaacatcacccgcttccagaccctcctggccctgcaccggtcctacctcacgccgggggacagcagctccagctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcagcggcaactacaactacctgtaccgcctgttccgcaagagcaagctcaagcccttcgagcgggacatctccaccgagatctaccaggccggcaacaagccctgcaacggggtggccggcagcaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 113 - RNA, 4100 nt, synthetic construct
  source 1..4100: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacaaggtcgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 114 - RNA, 4100 nt, synthetic construct
  source 1..4100: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccaggacgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 115 - RNA, 4100 nt, synthetic construct
  source 1..4100: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 116 - RNA, 4091 nt, synthetic construct
  source 1..4091: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtggagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgacgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactcccaccggcgcgcccggagcgtggcgtcccagagcatcatcgcctacaccatgtccctgggcgccgagaacagcgtcgcctactccaacaacagcatcgccatccccatcaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctcgcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccacccacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 117 - RNA, 4091 nt, synthetic construct
  source 1..4091: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacttcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgccaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccggggcctgccccaggggttcagcgccctcgagcccctggtggacctgcccatcggcatcaacatcacccgcttccagaccctccacatctcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgtggagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 118 - RNA, 4100 nt, synthetic construct
  source 1..4100: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacttcaccaaccgcacgcagctgccgagcgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaactaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctcagcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaccatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcagcaccccctgcaacggggtgaagggcttcaactgctacttccccctgcagtcctacgggttccagccgacctacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgatcaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 119 - RNA, 4094 nt, synthetic construct
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctccgcacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgaggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactaccgctaccgcctgttccgcaagagcaacctcaagcccttcgagcgggacatctccaccgagatctaccaggccggcagcaagccctgcaacggggtggagggcttcaactgctacttccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactcccgccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcagaacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 120 - RNA, 4079 nt, synthetic construct
  source 1..4079: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacgtgatcaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctggtccgggacctgccccaggggttcagcgccctcgagcccctggtggacctgcccatcggcatcaacatcacccgcttccagaccctcctggccctgcacgacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaactccgccagcttctccacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactaccagtaccgcctgttccgcaagagcaacctcaagcccttcgagcgggacatctccaccgagatctaccaggccggcagcaccccctgcaacggggtggagggcttcaactgctacagccccctgcagtcctacgggttccagccgaccaacggcgtggggtaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagcacgtgaacaactcctacgagtgcgacatccccatcggggccggcatctgcgccagctaccagacgcagaccaactccccgcggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaaccgcgcgctgacggggatcgccgtggagcaggacaagaacacccaggaggtgttcgcccaggtcaagcagatctacaagacgcccccgatcaaggacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaacgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccagaacgcccaggccctgaacacgctcgtgaagcagctgtccagcaacttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 121 - RNA, 4091 nt, synthetic construct
  source 1..4091: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgtgatctccgggaccaacggcaccaagcggttcgacaacccggtgctgcccttcaacgacggggtctacttcgcgagcatcgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcatcgtccgggagcccgaggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccacccggttcgccagcgtctacgcctggaaccgcaagcggatctccaactgcgtggcggactacagcgtgctgtacaacctggcccccttcttcacgttcaagtgctacggcgtcagccccaccaagctcaacgacctgtgcttcaccaacgtgtacgccgactccttcgtgatccgcggggacgaggtccggcagatcgcccccggccagaccgggaacatcgccgactacaactacaagctgccggacgacttcacgggctgcgtgatcgcgtggaacagcaacaagctcgactccaaggtcagcggcaactacaactacctgtaccgcctgttccgcaagagcaacctcaagcccttcgagcgggacatctccaccgagatctaccaggccggcaacaagccctgcaacggggtggccggcttcaactgctacttccccctgcgctcctacagcttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaaggggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaagggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcttctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 122 - RNA, 4091 nt, synthetic construct
  source 1..4091: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcaccacccgcacgcagctgccgcccgcctacaccaacagcttcacccggggcgtctactaccccgacaaggtgttccgctccagcgtgctgcactccacccaggacctcttcctgcccttcttcagcaacgtcacgtggttccacgtgatctccgggaccaacggcaccaagcggttcgacaacccggtgctgcccttcaacgacggggtctacttcgcgagcatcgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcatcgtccgggagcccgaggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccacccggttcgccagcgtctacgcctggaaccgcaagcggatctccaactgcgtggcggactacagcgtgctgtacaacctggcccccttcttcacgttcaagtgctacggcgtcagccccaccaagctcaacgacctgtgcttcaccaacgtgtacgccgactccttcgtgatccgcggggacgaggtccggcagatcgcccccggccagaccgggaagatcgccgactacaactacaagctgccggacgacttcacgggctgcgtgatcgcgtggaacagcaacaacctcgactccaaggtcgggggcaactacaactacctgtaccgcctgttccgcaagagcaacctcaagcccttcgagcgggacatctccaccgagatctaccaggccggcaacaagccctgcaacggggtggccggcttcaactgctacttccccctgcgctcctacagcttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaaggggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaagggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcttctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 123 - RNA, 4091 nt, synthetic construct
  source 1..4091: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccacccggttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcgggggcaactacaactacctgtaccgcctgttccgcaagagcaacctcaagcccttcgagcgggacatctccaccgagatctaccaggccggcaacaagccctgcaacggggtggccggcttcaactgctacttccccctgcgctcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 124 - RNA, 4085 nt, synthetic construct
  source 1..4085: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccacccggttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcgggggcaactacaactaccgctaccgcctgttccgcaagagcaacctcaagcccttcgagcgggacatctccaccgagatctaccaggccggcaacaagccctgcaacggggtggccggcgtgaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacagctcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 125 - RNA, 4085 nt, synthetic construct
  source 1..4085: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccacccggttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcgggggcaactacaactaccgctaccgcctgttccgcaagagcaacctcaagcccttcgagcgggacatctccaccgagatctaccaggccggcaacaagccctgcaacggggtggccggcgtgaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 126 - RNA, 4085 nt, synthetic construct
  source 1..4085: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccacccggttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtccggcagatcgcccccggccagaccgggaacatcgccgactacaactacaagctgccggacgacttcacgggctgcgtgatcgcgtggaacagcaacaagctcgactccaaggtcgggggcaactacaactaccgctaccgcctgttccgcaagagcaacctcaagcccttcgagcgggacatctccaccgagatctaccaggccggcaacaagccctgcaacggggtggccggcgtgaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 127 - RNA, 4088 nt, synthetic construct; identical to SEQ ID NO: 102
  source 1..4088: mol_type = other RNA
  modified_base 1..4088: mod_base = m1f

SEQ ID NO: 128 - RNA, 4088 nt, synthetic construct; identical to SEQ ID NO: 103
  source 1..4088: mol_type = other RNA
  modified_base 1..4088: mod_base = m1f

SEQ ID NO: 129 - RNA, 4085 nt, synthetic construct; identical to SEQ ID NO: 104
  source 1..4085: mol_type = other RNA
  modified_base 1..4085: mod_base = m1f

SEQ ID NO: 130 - RNA, 4082 nt, synthetic construct; identical to SEQ ID NO: 105
  source 1..4082: mol_type = other RNA
  modified_base 1..4082: mod_base = m1f

SEQ ID NO: 131 - RNA, 4085 nt, synthetic construct; identical to SEQ ID NO: 106
  source 1..4085: mol_type = other RNA
  modified_base 1..4085: mod_base = m1f

SEQ ID NO: 132 - RNA, 4091 nt, synthetic construct; identical to SEQ ID NO: 107
  source 1..4091: mol_type = other RNA
  modified_base 1..4091: mod_base = m1f

SEQ ID NO: 133 - RNA, 4091 nt, synthetic construct; identical to SEQ ID NO: 108
  source 1..4091: mol_type = other RNA
  modified_base 1..4091: mod_base = m1f

SEQ ID NO: 134 - RNA, 4091 nt, synthetic construct; identical to SEQ ID NO: 109
  source 1..4091: mol_type = other RNA
  modified_base 1..4091: mod_base = m1f

SEQ ID NO: 135 - RNA, 4091 nt, synthetic construct; identical to SEQ ID NO: 110
  source 1..4091: mol_type = other RNA
  modified_base 1..4091: mod_base = m1f

SEQ ID NO: 136 - RNA, 4091 nt, synthetic construct; identical to SEQ ID NO: 111
  source 1..4091: mol_type = other RNA
  modified_base 1..4091: mod_base = m1f

SEQ ID NO: 137 - RNA, 4091 nt, synthetic construct; identical to SEQ ID NO: 112
  source 1..4091: mol_type = other RNA
  modified_base 1..4091: mod_base = m1f

SEQ ID NO: 138 - RNA, 4100 nt, synthetic construct; identical to SEQ ID NO: 113
  source 1..4100: mol_type = other RNA
  modified_base 1..4100: mod_base = m1f

SEQ ID NO: 139 - RNA, 4100 nt, synthetic construct; identical to SEQ ID NO: 114
  source 1..4100: mol_type = other RNA
  modified_base 1..4100: mod_base = m1f

SEQ ID NO: 140 - RNA, 4100 nt, synthetic construct; identical to SEQ ID NO: 115
  source 1..4100: mol_type = other RNA
  modified_base 1..4100: mod_base = m1f

SEQ ID NO: 141 - RNA, 4091 nt, synthetic construct; identical to SEQ ID NO: 116
  source 1..4091: mol_type = other RNA
  modified_base 1..4091: mod_base = m1f

SEQ ID NO: 142 - RNA, 4091 nt, synthetic construct; identical to SEQ ID NO: 117
  source 1..4091: mol_type = other RNA
  modified_base 1..4091: mod_base = m1f

SEQ ID NO: 143 - RNA, 4100 nt, synthetic construct; identical to SEQ ID NO: 118
  source 1..4100: mol_type = other RNA
  modified_base 1..4100: mod_base = m1f

SEQ ID NO: 144 - RNA, 4094 nt, synthetic construct; identical to SEQ ID NO: 119
  source 1..4094: mol_type = other RNA
  modified_base 1..4094: mod_base = m1f

SEQ ID NO: 145 - RNA, 4079 nt, synthetic construct; identical to SEQ ID NO: 120
  source 1..4079: mol_type = other RNA
  modified_base 1..4079: mod_base = m1f

SEQ ID NO: 146 - RNA, 4091 nt, synthetic construct; identical to SEQ ID NO: 121
  source 1..4091: mol_type = other RNA
  modified_base 1..4091: mod_base = m1f

SEQ ID NO: 147 - RNA, 4091 nt, synthetic construct; identical to SEQ ID NO: 122
  source 1..4091: mol_type = other RNA
  modified_base 1..4091: mod_base = m1f

SEQ ID NO: 148 - RNA, 4091 nt, synthetic construct; identical to SEQ ID NO: 123
  source 1..4091: mol_type = other RNA
  modified_base 1..4091: mod_base = m1f

SEQ ID NO: 149 - RNA, 4085 nt, synthetic construct; identical to SEQ ID NO: 124
  source 1..4085: mol_type = other RNA
  modified_base 1..4085: mod_base = m1f

SEQ ID NO: 150 - RNA, 4085 nt, synthetic construct; identical to SEQ ID NO: 125
  source 1..4085: mol_type = other RNA
  modified_base 1..4085: mod_base = m1f

SEQ ID NO: 151 - RNA, 4085 nt, synthetic construct; identical to SEQ ID NO: 126
  source 1..4085: mol_type = other RNA
  modified_base 1..4085: mod_base = m1f

SEQ ID NO: 152 - RNA, 4100 nt, synthetic construct
  source 1..4100: mol_type = other RNA
  modified_base 1..4100: mod_base = m1f
gggaaataagagagaaaagaagagtaagaagaaatataagaccccggcgccgccaccatgttcgtgttcctggtgctgctgcccctggtgagcagccagtgcgtgaacctgaccacccggacccagctgccaccagcctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgtgctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctgggcgtgtactaccacaagaacaacaagagctggatggagagcgagttccgggtgtacagcagcgccaacaactgcaccttcgagtacgtgagccagcccttcctgatggacctggagggcaagcagggcaacttcaagaacctgcgggagttcgtgttcaagaacatcgacggctacttcaagatctacagcaagcacaccccaatcaacctggtgcgggatctgccccagggcttctcagccctggagcccctggtggacctgcccatcggcatcaacatcacccggttccagaccctgctggccctgcaccggagctacctgaccccaggcgacagcagcagcgggtggacagcaggcgcggctgcttactacgtgggctacctgcagccccggaccttcctgctgaagtacaacgagaacggcaccatcaccgacgccgtggactgcgccctggaccctctgagcgagaccaagtgcaccctgaagagcttcaccgtggagaagggcatctaccagaccagcaacttccgggtgcagcccaccgagagcatcgtgcggttccccaacatcaccaacctgtgccccttcggcgaggtgttcaacgccacccggttcgccagcgtgtacgcctggaaccggaagcggatcagcaactgcgtggccgactacagcgtgctgtacaacagcgccagcttcagcaccttcaagtgctacggcgtgagccccaccaagctgaacgacctgtgcttcaccaacgtgtacgccgacagcttcgtgatccgtggcgacgaggtgcggcagatcgcacccggccagacaggcaagatcgccgactacaactacaagctgcccgacgacttcaccggctgcgtgatcgcctggaacagcaacaacctcgacagcaaggtgggcggcaactacaactacctgtaccggctgttccggaagagcaacctgaagcccttcgagcgggacatcagcaccgagatctaccaagccggctccaccccttgcaacggcgtggagggcttcaactgctacttccctctgcagagctacggcttccagcccaccaacggcgtgggctaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccaggacgtgaactgcaccgaggtgcccgtggccatccacgccgaccagctgacacccacctggcgggtctacagcaccggcagcaacgtgttccagacccgggccggttgcctgatcggcgccgagcacgtgaacaacagctacgagtgcgacatccccatcggcgccggcatctgtgccagctaccagacccagaccaattcaccccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaaccgggccctgaccggcatcgccgtggagcaggacaagaacacccaggaggtgttcgcccaggtgaagcagatctacaagacccctcccatcaaggacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccagaacgcccaggccctgaacaccctggtgaagcagctgagcagcaacttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgataataggctggagcctcggtggcctagcttcttgccccttgggcctccccccagcccctcctccccttcctgcacccgtacccccgtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 153 - RNA, 3813 nt, synthetic construct; identical to SEQ ID NO: 96
  source 1..3813: mol_type = other RNA
  modified_base 1..3813: mod_base = m1f

SEQ ID NO: 154 - RNA, 3813 nt, synthetic construct; identical to SEQ ID NO: 97
  source 1..3813: mol_type = other RNA
  modified_base 1..3813: mod_base = m1f

SEQ ID NO: 155 - RNA, 3807 nt, synthetic construct; identical to SEQ ID NO: 98
  source 1..3807: mol_type = other RNA
  modified_base 1..3807: mod_base = m1f

SEQ ID NO: 156 - RNA, 4283 nt, synthetic construct
  source 1..4283: mol_type = other RNA
  modified_base 1..4283: mod_base = m1f
agaataaactagtattcttctggtccccacagactcagagagaacccgccaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctgggcgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcgtgcgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcggcgaggtgttcaatgccaccagattcgcctctgtgtacgcctggaaccggaagcggatcagcaattgcgtggccgactactccgtgctgtacaactccgccagcttcagcaccttcaagtgctacggcgtgtcccctaccaagctgaacgacctgtgcttcacaaacgtgtacgccgacagcttcgtgatccggggagatgaagtgcggcagattgcccctggacagacaggcaagatcgccgactacaactacaagctgcccgacgacttcaccggctgtgtgattgcctggaacagcaacaacctggactccaaagtcggcggcaactacaattacctgtaccggctgttccggaagtccaatctgaagcccttcgagcgggacatctccaccgagatctatcaggccggcagcaccccttgtaacggcgtggaaggcttcaactgctacttcccactgcagtcctacggctttcagcccacaaatggcgtgggctatcagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccaggacgtgaactgtaccgaagtgcccgtggccattcacgccgatcagctgacacctacatggcgggtgtactccaccggcagcaatgtgtttcagaccagagccggctgtctgatcggagccgagcacgtgaacaatagctacgagtgcgacatccccatcggcgctggaatctgcgccagctaccagacacagacaaacagccctcggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaatagagccctgacagggatcgccgtggaacaggacaagaacacccaagaggtgttcgcccaagtgaagcagatctacaagacccctcctatcaaggacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccagaatgcccaggcactgaacaccctggtcaagcagctgtcctccaacttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgatgactcgagctggtactgcatgcacgcaatgctagctgcccctttcccgtcctgggtaccccgagtctcccccgacctcgggtcccaggtatgctcccacctccacctgccccactcaccacctctgctagttccagacacctcccaagcacgcagcaatgcagctcaaaacgcttagcctagccacacccccacgggaaacagcagtgattaacctttagcaataaacgaaagtttaactaagctatactaaccccagggttggtcaatttcgtgccagccacaccctggagctagcaaaaaaaaaaaaaaaaaaaaaaaaaaaaaagcatatgactaaaaaaaaaaaaaaaaaaaaaaaaaaaaaaaaaaaaaaaaaaaaaaaaaaaaaaaaaaaaaaaaaaaaaa

SEQ ID NO: 157 - RNA, 4274 nt, synthetic construct
  source 1..4274: mol_type = other RNA
  modified_base 1..4274: mod_base = m1f
agaataaactagtattcttctggtccccacagactcagagagaacccgccaccatgttcgtgttcctggtgctgctgcctctggtgtccagccagtgtgtgaacctgaccaccagaacacagctgcctccagcctacaccaacagctttaccagaggcgtgtactaccccgacaaggtgttcagatccagcgtgctgcactctacccaggacctgttcctgcctttcttcagcaacgtgacctggttccacgtgatctccggcaccaatggcaccaagagattcgacaaccccgtgctgcccttcaacgacggggtgtactttgccagcatcgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctggaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcatcgtgagagagcccgaggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcgacgaggtgttcaatgccaccagattcgcctctgtgtacgcctggaaccggaagcggatcagcaattgcgtggccgactactccgtgctgtacaacctggcccccttcttcaccttcaagtgctacggcgtgtcccctaccaagctgaacgacctgtgcttcacaaacgtgtacgccgacagcttcgtgatccggggagatgaagtgcggcagattgcccctggacagacaggcaacatcgccgactacaactacaagctgcccgacgacttcaccggctgtgtgattgcctggaacagcaacaagctggactccaaagtcagcggcaactacaattacctgtaccggctgttccggaagtccaatctgaagcccttcgagcgggacatctccaccgagatctatcaggccggcaacaagccttgtaacggcgtggccggcttcaactgctacttcccactgcggtcctacagctttaggcccacatacggcgtgggccaccagccctacagagtggtggtgctgagcttcgaactgctgcatgcccctgccacagtgtgcggccctaagaaaagcaccaatctcgtgaagaacaaatgcgtgaacttcaacttcaacggcctgaagggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaagagccaccggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaaaagagccctgacagggatcgccgtggaacaggacaagaacacccaagaggtgttcgcccaagtgaagcagatctacaagacccctcctatcaagtacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaagggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccacaatgcccaggcactgaacaccctggtcaagcagctgtcctccaagttcggcgccatcagctctgtgctgaacgatatcttcagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgatgactcgagctggtactgcatgcacgcaatgctagctgcccctttcccgtcctgggtaccccgagtctcccccgacctcgggtcccaggtatgctcccacctccacctgccccactcaccacctctgctagttccagacacctcccaagcacgcagcaatgcagctcaaaacgcttagcctagccacacccccacgggaaacagcagtgattaacctttagcaataaacgaaagtttaactaagctatactaaccccagggttggtcaatttcgtgccagccacaccctggagctagcaaaaaaaaaaaaaaaaaaaaaaaaaaaaaagcatatgactaaaaaaaaaaaaaaaaaaaaaaaaaaaaaaaaaaaaaaaaaaaaaaaaaaaaaaaaaaaaaaaaaaaaaa

SEQ ID NO: 158 - RNA, 4268 nt, synthetic construct
  source 1..4268: mol_type = other RNA
  modified_base 1..4268: mod_base = m1f
agaataaactagtattcttctggtccccacagactcagagagaacccgccaccatgttcgtgttcctggtgctgctgcctctggtgtccagccagtgtgtgaacctgatcaccagaacacagtcatacaccaacagctttaccagaggcgtgtactaccccgacaaggtgttcagatccagcgtgctgcactctacccaggacctgttcctgcctttcttcagcaacgtgacctggttccacgccatctccggcaccaatggcaccaagagattcgacaaccccgtgctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctggacgtctactaccacaagaacaacaagagctggatggaaagcgagttccgggtgtacagcagcgccaacaactgcaccttcgagtacgtgtcccagcctttcctgatggacctggaaggcaagcagggcaacttcaagaacctgcgcgagttcgtgtttaagaacatcgacggctacttcaagatctacagcaagcacacccctatcaacctcggccgggatctgcctcagggcttctctgctctggaacccctggtggatctgcccatcggcatcaacatcacccggtttcagacactgctggccctgcacagaagctacctgacacctggcgatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttcgacgaggtgttcaatgccaccagattcgcctctgtgtacgcctggaaccggaagcggatcagcaattgcgtggccgactactccgtgctgtacaacttcgcccccttcttcgcattcaagtgctacggcgtgtcccctaccaagctgaacgacctgtgcttcacaaacgtgtacgccgacagcttcgtgatccggggaaacgaagtgcggcagattgcccctggacagacaggcaacatcgccgactacaactacaagctgcccgacgacttcaccggctgtgtgattgcctggaacagcaacaagctggactccaaagtcggcggcaactacaattacaggtaccggctgttccggaagtccaatctgaagcccttcgagcgggacatctccaccgagatctatcaggccggcaacaagccttgtaacggcgtggcaggcgtgaactgctacttcccactgcagtcctacggctttaggcccacatacggcgtgggccaccagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaagagccaccggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaaaagagccctgacagggatcgccgtggaacaggacaagaacacccaagaggtgttcgcccaagtgaagcagatctacaagacccctcctatcaagtacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccacaatgcccaggcactgaacaccctggtcaagcagctgtcctccaagttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgatgactcgagctggtactgcatgcacgcaatgctagctgcccctttcccgtcctgggtaccccgagtctcccccgacctcgggtcccaggtatgctcccacctccacctgccccactcaccacctctgctagttccagacacctcccaagcacgcagcaatgcagctcaaaacgcttagcctagccacacccccacgggaaacagcagtgattaacctttagcaataaacgaaagtttaactaagctatactaaccccagggttggtcaatttcgtgccagccacaccctggagctagcaaaaaaaaaaaaaaaaaaaaaaaaaaaaaagcatatgactaaaaaaaaaaaaaaaaaaaaaaaaaaaaaaaaaaaaaaaaaaaaaaaaaaaaaaaaaaaaaaaaaaaaaa

SEQ ID NO: 159 - protein, 1270 aa, synthetic construct
MFVFLVLLPLVSSQCVNLITRTQSYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYYHENNKSRMESELRVYSSANNCTFEYVSQPFLMDLEGKQGNFKNLREFVFKNIDGYFKIYSKHTPVNLGRDLPQGFSALEPLVDLPIGINITRFQTLLALHRSYLTPGDSSSSWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRTRISNCVADYSVLYNFAPFFAFKCYGVSPTKLNDLCFTNVYADSFVIRGNEVSQIAPGQTGNIADYNYKLPDDFTGCVIAWNSNKLDSKVSGNYNYLYRLFRKSKLKPFERDISTEIYQAGNKPCNGVAGFNCYSPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 160 - protein, 1270 aa, synthetic construct
MFVFLVLLPLVSSQCVNLITRTQSYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYYHENNKSRMESELRVYSSANNCTFEYVSQPFLMDLEGKQGNFKNLREFVFKNIDGYFKIYSKHTPVNLGRDLPQGFSALEPLVDLPIGINITRFQTLLALHRSYLTPGDSSSSWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVSGNYNYLYRLFRKSKLKPFERDISTEIYQAGNKPCNGVAGPNCYSPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 161 - protein, 1270 aa, synthetic construct
MFVFLVLLPLVSSQCVNLITRTQSYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYYHKNNKSWTESEFRVYSSAKNCTFEYVSQPFLMDLEGKQGNFKNLREFVFKNIDGYFKIYSKHTPINLGRDLPQGFSALEPLVDLPIGINITRFQTLLALNRSYLTPGDSSSDWTAGAAAYYVGYLQPRTFLLKYNENGTITDAVDCALDPLSETKCTLKSFTVEKGIYQTSNFRVQPTESIVRFPNITNLCPFDEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSRVGGNYDYMYRLFRKSKLKPFERDISTEIYQAGNKPCNGVRGFNCYFPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 162 - protein, 1269 aa, synthetic construct
MFVFLVLLPLVSSQCVNLITRTQSYTNSFTRGVYYPDKVFRSSVLHSTQDLFLPFFSNVTWFHAIHVSGTNGTKRFDNPALPFNDGVYFASTEKSNIIRGWIFGTTLDSKTQSLLIVNNATNVVIKVCEFQFCNDPFLDVYQKNNKSWMESEFRVYSSANNCTFEYVSQPFLMDLEGKEGNFKNLREFVFKNIDGYFKIYSKHTPINLERDLPQGFSALEPLVDLPIGINITRFQTLLALHRSYLTPVDSSSGWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVIYNFAPFFAFKCYGVSPTKLNDLCFTNVYADSFVIRGNEVSQIAPGQTGNIADYNYKLPDDFTGCVIAWNSNKLDSKPSGNYNYLYRLFRKSKLKPFERDISTEIYQAGNKPCNGVAGPNCYSPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 163 - protein, 1268 aa, synthetic construct
MFVFLVLLPLVSSQCVNLITRTQLSPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYHKNNKSWMESGVYSSANNCTFEYVSQPFLMDLEGKQGNFKNLREFVFKNIDGYFKIYSKHTLINSVRHLPQGFSVLEPLVDLPIGINITRFQTLLHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVSGNYNYMYRLFRKSNLKPFERDISTEIYQAGNKPCNGVAGPNCYFPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAEISVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 164 - protein, 1268 aa, synthetic construct
MFVFLVLLPLVSSQCVNLITRTQLSPAYTNSFTRGVYYPDKVFRSSVLHSTQDLFLPFFSNVTWFHAIHVSGTNGTKRFDNPVLPFNDGVYFASTERSNIIRGWIFGTTLDSKTQSLLIVNNATNVVIKVCEFQFCNDPFLDVYHKNNKSWMESGVYSSANNCTFEYVSQPFLMDLEGKQGNFKNLREFVFKNIDGYFKIYSKHTLINSVRHLPQGFSVLEPLVDLPIGINITRFQTLLHRSYLTPGDSSSGWTAGAAAYYVGYLQPRTFLLKYNENGTITDAVDCALDPLSETKCTLKSFTVEKGIYQTSNFRVQPTESIVRFPNITNLCPFGEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVSGNYNYLYRLFRKSNLKPFERDISTEIYQAGNKPCNGVAGPNCYFPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAEISVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 165 - RNA, 3813 nt, synthetic construct
  source 1..3813: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacgagaacaacaagagccgcatggagtccgagctgcgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccggtgaacctgggccgggacctgccccaggggttcagcgccctcgagcccctggtggacctgcccatcggcatcaacatcacccgcttccagaccctcctggccctgcaccggtcctacctcacgccgggggacagcagctccagctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcacccggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcagcggcaactacaactacctgtaccgcctgttccgcaagagcaagctcaagcccttcgagcgggacatctccaccgagatctaccaggccggcaacaagccctgcaacggggtggccggcttcaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 166 - RNA, 3813 nt, synthetic construct
  source 1..3813: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacgagaacaacaagagccgcatggagtccgagctgcgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccggtgaacctgggccgggacctgccccaggggttcagcgccctcgagcccctggtggacctgcccatcggcatcaacatcacccgcttccagaccctcctggccctgcaccggtcctacctcacgccgggggacagcagctccagctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 167 - RNA, 3813 nt, synthetic construct
  source 1..3813: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacaagaacaacaagagctggaccgagtccgagttccgggtctacagctccgccaagaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgaaccggtcctacctcacgccgggggacagcagctccgactggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccacccggttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactcccgcgtcgggggcaactacgactacatgtaccgcctgttccgcaagagcaagctcaagcccttcgagcgggacatctccaccgagatctaccaggccggcaacaagccctgcaacggggtgcgcggcttcaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 168 - RNA, 3810 nt, synthetic construct
  source 1..3810: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 169 - RNA, 3807 nt, synthetic construct
  source 1..3807: mol_type = other RNA
atgttcgtgttcctggtcctcctgcccctggtgagctcccagtgcgtgaacctcatcacccgcacgcagctgagccccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccacaagaacaacaagagctggatggagtccggcgtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccctgatcaacagcgtccggcacctcccccaggggttcagcgtgctcgagcccctggtggacctgcccatcggcatcaacatcacccgcttccagaccctcctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcagcggcaactacaactacatgtaccgcctgttccgcaagagcaacctcaagcccttcgagcgggacatctccaccgagatctaccaggccggcaacaagccctgcaacggggtggccggccccaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagatcagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 170 - RNA, 3807 nt, synthetic construct
  source 1..3807: mol_type = other RNA
atgttcgtgttcctggtcctcctgcccctggtgagctcccagtgcgtgaacctcatcacccgcacgcagctgagccccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagcgctccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccacaagaacaacaagagctggatggagtccggcgtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccctgatcaacagcgtccggcacctcccccaggggttcagcgtgctcgagcccctggtggacctgcccatcggcatcaacatcacccgcttccagaccctcctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcagcggcaactacaactacctgtaccgcctgttccgcaagagcaacctcaagcccttcgagcgggacatctccaccgagatctaccaggccggcaacaagccctgcaacggggtggccggccccaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagatcagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 171 - RNA, 4091 nt, synthetic construct
  source 1..4091: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacgagaacaacaagagccgcatggagtccgagctgcgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccggtgaacctgggccgggacctgccccaggggttcagcgccctcgagcccctggtggacctgcccatcggcatcaacatcacccgcttccagaccctcctggccctgcaccggtcctacctcacgccgggggacagcagctccagctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcacccggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcagcggcaactacaactacctgtaccgcctgttccgcaagagcaagctcaagcccttcgagcgggacatctccaccgagatctaccaggccggcaacaagccctgcaacggggtggccggcttcaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 172 - RNA, 4091 nt, synthetic construct
  source 1..4091: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacgagaacaacaagagccgcatggagtccgagctgcgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccggtgaacctgggccgggacctgccccaggggttcagcgccctcgagcccctggtggacctgcccatcggcatcaacatcacccgcttccagaccctcctggccctgcaccggtcctacctcacgccgggggacagcagctccagctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 173 - RNA, 4091 nt, synthetic construct
  source 1..4091: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacaagaacaacaagagctggaccgagtccgagttccgggtctacagctccgccaagaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgaaccggtcctacctcacgccgggggacagcagctccgactggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccacccggttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactcccgcgtcgggggcaactacgactacatgtaccgcctgttccgcaagagcaagctcaagcccttcgagcgggacatctccaccgagatctaccaggccggcaacaagccctgcaacggggtgcgcggcttcaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 174 - RNA, 4088 nt, synthetic construct
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 175 - RNA, 4085 nt, synthetic construct
  source 1..4085: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagctgagccccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccacaagaacaacaagagctggatggagtccggcgtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccctgatcaacagcgtccggcacctcccccaggggttcagcgtgctcgagcccctggtggacctgcccatcggcatcaacatcacccgcttccagaccctcctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcagcggcaactacaactacatgtaccgcctgttccgcaagagcaacctcaagcccttcgagcgggacatctccaccgagatctaccaggccggcaacaagccctgcaacggggtggccggccccaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagatcagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 176 - RNA, 4085 nt, synthetic construct
  source 1..4085: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagctgagccccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagcgctccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccacaagaacaacaagagctggatggagtccggcgtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccctgatcaacagcgtccggcacctcccccaggggttcagcgtgctcgagcccctggtggacctgcccatcggcatcaacatcacccgcttccagaccctcctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccacccggttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcagcggcaactacaactacctgtaccgcctgttccgcaagagcaacctcaagcccttcgagcgggacatctccaccgagatctaccaggccggcaacaagccctgcaacggggtggccggccccaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagatcagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 177 - RNA, 4091 nt, synthetic construct; identical to SEQ ID NO: 171
  source 1..4091: mol_type = other RNA
  modified_base 1..4091: mod_base = m1f

SEQ ID NO: 178 - RNA, 4091 nt, synthetic construct; identical to SEQ ID NO: 172
  source 1..4091: mol_type = other RNA
  modified_base 1..4091: mod_base = m1f

SEQ ID NO: 179 - RNA, 4091 nt, synthetic construct; identical to SEQ ID NO: 173
  source 1..4091: mol_type = other RNA
  modified_base 1..4091: mod_base = m1f

SEQ ID NO: 180 - RNA, 4088 nt, synthetic construct; identical to SEQ ID NO: 174
  source 1..4088: mol_type = other RNA
  modified_base 1..4088: mod_base = m1f

SEQ ID NO: 181 - RNA, 4085 nt, synthetic construct; identical to SEQ ID NO: 175
  source 1..4085: mol_type = other RNA
  modified_base 1..4085: mod_base = m1f

SEQ ID NO: 182 - RNA, 4085 nt, synthetic construct; identical to SEQ ID NO: 176
  source 1..4085: mol_type = other RNA
  modified_base 1..4085: mod_base = m1f

SEQ ID NO: 183 - protein, 1267 aa, synthetic construct
MFVFLVLLPLVSSQCVNLITRTQSYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLDVYHKNNKSWMESEFRVYSSANNCTFEYVSQPFLMDLEGKQGNFKNLREFVFKNIDGYFKIYSKHTPINLGRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFDEVFNATTFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSTVGGNYNYRYRLFRKSKLKPFERDISTEIYQAGNKPCNGVAGVNCYFPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 184 - protein, 1269 aa, synthetic construct
MFVFLVLLPLVSSQCVNLITRTQSYTNSFTRGVYYPDKVFRSSVLHSTQDLFLPFFSNVTWFHAIHVSGTNGTKRFDNPALPFNDGVYFASTEKSNIIRGWIFGTTLDSKTQSLLIVNNATNVVIKVCEFQFCNDPFLDVYQKNNKSWMESEFRVYSSANNCTFEYVSQPFLMDLVGKEGNFKNLREFVFKNIDGYFKIYSKHTPINLERDLPQGFSALEPLVDLPIGINITRFQTLLALHRSYLTPVDSSSGWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVIYNFAPFFAFKCYGVSPTKLNDLCFTNVYADSFVIRGNEVSQIAPGQTGNIADYNYKLPDDFTGCVIAWNSNKLDSKPSGNYNYLYRLFRKSKLKPFERDISTEIYQAGNRPCNGVAGPNCYSPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 185 - protein, 1269 aa, synthetic construct
MFVFLVLLPLVSSQCVNLITRTQSYTNSFTRGVYYPDKVFRSSVLHSTQDLFLPFFSNVTWFHAIHVSGTNGTKRFDNPALPFNDGVYFASTEKSNIIRGWIFGTTLDSKTQSLLIVNNATNVVIKVCEFQFCNDPFLDVYQKNNKSWMESEFRVYSSANNCTFEYVSQPFLMDLVGKEGNFKNLREFVFKNIDGYFKIYSKHTPINLERDLPQGFSALEPLVDLPIGINITRFQTLLALHRSYLTPVDSSSGWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVIYNFAPFFAFKCYGVSPTKLNDLCFTNVYADSFVIRGNEVSQIAPGQTGNIADYNYKLPDDFTGCVIAWNSNKLDSKPSGNYNYLYRLFRKSKLKPFERDISTEIYQAGNRPCNGVAGPNCYSPLQSYGFRPTYGVGHQPYRVVVLSFELLHAPATVCGPKKSTNLVKNKCVNFNFNGLIGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 186 - protein, 1269 aa, synthetic construct
MFVFLVLLPLVSSQCVNLITRTQSYTNSFTRGVYYPDKVFRSSVLHSTQDLFLPFFSNVTWFHAIHVSGTNGTKRFDNPALPFNDGVYFASTEKSNIIRGWIFGTTLDSKTQSLLIVNNATNVVIKVCEFQFCNDPFLDVYQKNNKSWMESEFRVYSSANNCTFEYVSQPFLMDLEGKEGNFKNLREFVFKNIDGYFKIYSKHTPINLERHLPQGFSALEPLVDLPIGINITRFQTLLALHRSYLTPVDSSSGWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVIYNFAPFFAFKCYGVSPTKLNDLCFTNVYADSFVIRGNEVSQIAPGQTGNIADYNYKLPDDFTGCVIAWNSNKLDSKPSGNYNYLYRLFRKSKLKPFERDISTEIYQAGNKPCNGVAGPNCYSPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 187 - protein, 1269 aa, synthetic construct
MFVFLVLLPLVSSQCVNLITRTQSYTNSFTRGVYYPDKVFRSSVLHSTQDLFLPFFSNVTWFHAIHVSGTNGTKRFDNPALPFNDGVYFASTEKSNIIRGWIFGTTLDSKTQSLLIVNNATNVVIKVCEFQFCNDPFLDVYQKNNKSWMESEFRVYSSANNCTFEYVSQPFLMDLEGKEGNFKNLREFVFKNIDGYFKIYSKHTPINLERDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVIYNFAPFFAFKCYGVSPTKLNDLCFTNVYADSFVIRGNEVSQIAPGQTGNIADYNYKLPDDFTGCVIAWNSNKLDSKPSGNYNYLYRLFRKSKLKPFERDISTEIYQAGNKPCNGVAGPNCYSPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 188 - protein, 1269 aa, synthetic construct
MFVFLVLLPLVSSQCVNLITRTQSYTNSFTRGVYYPDKVFRSSVLHSTQDLFLPFFSNVTWFHAIHVSGTNGTKRFDNPALPFNDGVYFASTEKSNIIRGWIFGTTLDSKTQSLLIVNNATNVVIKVCEFQFCNDPFLDVYQKNNKSWMESEFRVYSSANNCTFEYVSQPFLMDLEGKEGNFKNLREFVFKNIDGYFKIYSKHTPINLERDLPQGFSALEPLVDLPIGINITRFQTLLALHRSYLTPGGSSSGWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVIYNFAPFFAFKCYGVSPTKLNDLCFTNVYADSFVIRGNEVSQIAPGQTGNIADYNYKLPDDFTGCVIAWNSNKLDSKPSGNYNYLYRLFRKSKLKPFERDISTEIYQAGNKPCNGVAGPNCYSPLQSYGFRPTYGVGHQPYRVVVLSFELLHASATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 189 - protein, 1269 aa, synthetic construct
MFVFLVLLPLVSSQCVNLITRTQSYTNSFTRGVYYPDKVFRSSVLHSTQDLFLPFFSNVTWFHAIHVSGTNGTKRFYNPALPFNDGVYFASTEKSNIIRGWIFGTTLDSKTQSLLIVNNATNVVIKVCEFQFCNDPFLDVYQKNNKSWMESEFRVYSSANNCTFEYVSQPFLMDLEGKEGNFKNLREFVFKNIDGYFKIYSKHTPINLERDLPQGFSALEPLVDLPIGINITRFQTLLALHRSYLTPGGSSSGWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVIYNFAPFFAFKCYGVSPTKLNDLCFTNVYADSFVIRGNEVSQIAPGQTGNIADYNYKLPDDFTGCVIAWNSNKLDSKPSGNYNYLYRLFRKSKLKPFERDISTEIYQAGNKPCNGVAGPNCYSPLQSYGFRPTYGVGHQPYRVVVLSFELLHASATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 190 - protein, 1269 aa, synthetic construct
MFVFLVLLPLVSSQCVNLITRTQSYTNSFTRGVYYPDKVFRSSVLHSTQDLFLPFFSNVTWFHAIHVSGTNGTKRFDNPALPFNDGVYFASTEKSNIIRGWIFGTTLDSKTQSLLIVNNATNVVIKVCEFQFCNDPFLDVYQKNNKSWMESEFRVYSSANNCTFEYVSQPFLMDLEGKEVNFKNLREFVFKNIDGYFKIYSKHTPINLERDLPQGFSALEPLVDLPIGINITRFQTLLALHRSYLTPGGSSSGWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVIYNFAPFFAFKCYGVSPTKLNDLCFTNVYADSFVIRGNEVSQIAPGQTGNIADYNYKLPDDFTGCVIAWNSNKLDSKPSGNYNYLYRLFRKSKLKPFERDISTEIYQAGNKPCNGVAGPNCYSPLQSYGFRPTYGVGHQPYRVVVLSFELLHASATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 191 - protein, 1271 aa, synthetic construct
MFVFLVLLPLVSSQCVNFRTGTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLGVYYHKNNKSLMESGVYSSANNCTFEYVSQPFLMDLEGKQGNLKNLREFVFKNIDGYFKIYSKHTPINLGRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFDEVFNATRFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVDGNYNYRYRLFRKSNLKPFERDISTEIYQAGNKPCNGVAGPNCYFPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVSVAIHADQLTPTWRVYSTGSNVFQTRAGCLIGAEYVNNSYECDIPIGAGICASYQTQTKSHRRARSVASQSIIAYTMSLGAENSVVYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITIDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 192 - protein, 1269 aa, synthetic construct
MFVFLVLLPLVSSQCVNLITRTQSYTNSFTRGVYYPDKVFRSSVLHSTQDLFLPFFSNVTWFHAIHVSGTNGTKRFDNPALPFNDGVYFASTEKSNIIRGWIFGTTLDSKTQSLLIVNNATNVVIKVCEFQFCNDPFLDVYKKNNKSWMESEFRVYSSANNCTFEYVSQPFLMDLEGKEGNFKNLREFVFKNIDGYFKIYSKHTPINLERDLPQGFSALEPLVDLPIGINITRFQTLLALHRSYLTPVDSSSGWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVIYNFAPFFAFKCYGVSPTKLNDLCFTNVYADSFVIRGNEVSQIAPGQTGNIADYNYKLPDDFTGCVIAWNSNKLDSKPSGNYNYLYRLFRKSKLKPFERDISTEIYQAGNKPCNGVAGPNCYSPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 193 - protein, 1268 aa, synthetic construct
MFVFLVLLPLVSSQCVNLITRTQSYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLDVYYHKNNKSWMESEFRVYSSANNCTFEYVSQPFLMDLEGKQGNFKNLREFVFKNIDGYFKIYSKHTPINLGRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFDEVFNATTFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVAGVNCYFPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 194 - protein, 1268 aa, synthetic construct
MFVFLVLLPLVSSQCVNLITRTQSYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLDVYYHKNNKSWMESEFRVYSSANNCTFEYVSQPFLMDLEGKQGNFKNLREFVFKNIDGYFKIYSKHTPINLGRDLPQGFSALEPLVDLPIGINITRFQTLLALHRSYLTPGDSSSGWTAGAAAYYVGYLQPRTFLLKYNENGTITDAVDCALDPLSETKCTLKSFTVEKGIYQTSNFRVQPTESIVRFPNITNLCPFDEVFNATTFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVGGNYNYRYRLFRKSNLKPFERDISTEIYQAGNKPCNGVAGVNCYFPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSFLKGCCSCGSCCKFDEDDSEPVLKGVKLHYT

SEQ ID NO: 195 - protein, 1270 aa, synthetic construct
MFVFLVLLPLVSSQCVNLITRTQSYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYYHENNKSRMESELRVYSSANNCTFEYVSQPFLMDLEGKQGNFKNLREFVFKNIDGYFKIYSKHTPVNLGRDLPQGFSALEPLVDLPIGINITRFQTLLALHRSYLTPGDSSSSWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSTVSGNYNYRYRLFRKSKLKPFERDISTEIYQAGNKPCNGVAGSNCYFPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 196 - protein, 1270 aa, synthetic construct
MFVFLVLLPLVSSQCVNLITRTQSYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYYHENNKSRMESELRVYSSANNCTFEYVSQPFLMDLEGKQGDFKNLREFVFKNIDGYFKIYSKHTPVNLGRDLPQGFSALEPLVDLPIGINITRFQTLLALHRSYLTPGDSSSSWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSTVSGNYNYRYRLFRKSKLKPFERDISTEIYQAGNKPCNGVAGSNCYFPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 197 - protein, 1270 aa, synthetic construct
MFVFLVLLPLVSSQCVNLITRTQSYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYYHENNKSRMESELRVYSSANNCTFEYVSQPFLMDLEGKQGNFKNLREFVFKNIDGYFKIYSKHTPVNLGRDLPQGFSALEPLVDLPIGINITRFQTLLALHRSYLTPGDSSSSWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSTVSGNYNYRYRLFRKSKLKPFERDISTEIYQAGNKPCNGVAGSNCYFPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTIISGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 198 - protein, 1267 aa, synthetic construct
MFVFLVLLPLVSSQCVNLITRTQSYTNSFTRGVYYPDKVFRSSVLHSTQDLFLPFFSNVTWFHAISGTNGTKRFDNPVLPFNDGVYFASTEKSNIIRGWIFGTTLDSKTQSLLIVNNATNVVIKVCEFQFCNDPFLDVYHKNNKSWMESEFRVYSSANNCTFEYVSQPFLMDLEGKQGNFKNLREFVFKNIDGYFKIYSKHTPINLGRDLPQGFSALEPLVDLPIGINITRFQTLLALHRSYLTPGGSSSGWTAGAAAYYVGYLQPRTFLLKYNENGTITDAVDCALDPLSETKCTLKSFTVEKGIYQTSNFRVQPTESIVRFPNITNLCPFDEVFNATTFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSTVGGNYNYRYRLFRKSKLKPFERDISTEIYQAGNKPCNGVAGVNCYFPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 199 - protein, 1269 aa, synthetic construct
MFVFLVLLPLVSSQCVNLITRTQSYTNSFTRGVYYPDKVFRSSVLHSTQDLFLPFFSNVTWFHAIHVSGTNGTKRFDNPALPFNDGVYFASTEKSNIIRGWIFGTTLDSKTQSLLIVNNATNVVIKVCEFQFCNDPFLDVYQKNNKSWMESEFRVYSSANNCTFEYVSQPFLMDLEGKEGNFKNLREFVFKNIDGYFKIYSKHTPINLERDLPQGFSALEPLVDLPIGINITRFQTLLALHRSYLTPVDSSSGWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVIYNFAPFFAFKCYGVSPTKLNDLCFTNVYADSFVIRGNEVSQIAPGQTGNIADYNYKLPDDFTGCVIAWNSNKLDSKPSGNYNYLYRLFRKSKLKPFERDISTEIYQAGNKPCNGVAGPNCYSPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYHGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 200 - protein, 1268 aa, synthetic construct
MFVFLVLLPLVSSQCVNLITRTQLSPAYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYHKNNKSWMESGVYSSANNCTFEYVSQPFLMDLEGKQGNFKNLREFVFKNIDGYFKIYSKHTLINSVRHLPQGFSVLEPLVDLPIGINITRFQTLLHRSYLTPGDSSLGWTAGAAAYYVGYLQPRTFLLKYNENGTITDAVDCALDPLSETKCTLKSFTVEKGIYQTSNFRVQPTESIVRFPNITNLCPFGEVFNATSFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVSGNYNYRYRLFRKSNLKPFERDISTEIYQAGNKPCNGVAGPNCYFPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAEISVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 201 - protein, 1269 aa, synthetic construct
MFVFLVLLPLVSSQCVNLITRTQSYTNSFTRGVYYPDKVFRSSVLHSTQDLFLPFFSNVTWFHAIHVSGTNGTKRFDNPALPFNDGVYFASTEKSNIIRGWIFGTTLDSKTQSLLIVNNATNVVIKVCEFQFCNDPFLDVYQKNNKSWMESEFRVYSSANNCTFEYVSQPFLMDLEGKEGNFKNLREFVFKNIDGYFKIYSKHTPINLERDLPQGFSALEPLVDLPIGINITRFQTLLALHRSYLTPVDSSSGWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVIYNFAPFFAFKCYGVSPTKLNDLCFTNVYADSFVIRGNEVSQVAPGQTGNIADYNYKLPDDFTGCVIAWNSNKLDSKPSGNYNYLYRLFRKSKLKPFERDISTEIYQAGNKPCNGVAGPNCYSPLQSYGFRPTYGVGHQPYRVVVLSFELLHASATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 202 - RNA, 3804 nt, synthetic construct
  source 1..3804: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaccgtcgggggcaactacaactaccgctaccgcctgttccgcaagagcaagctcaagcccttcgagcgggacatctccaccgagatctaccaggccggcaacaagccctgcaacggggtggccggcgtgaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 203 - RNA, 3810 nt, synthetic construct
  source 1..3810: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggtgggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaaccgcccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 204 - RNA, 3810 nt, synthetic construct
  source 1..3810: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggtgggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaaccgcccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcatcgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 205 - RNA, 3810 nt, synthetic construct
  source 1..3810: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcggcacctcccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 206 - RNA, 3810 nt, synthetic construct
  source 1..3810: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 207 - RNA, 3810 nt, synthetic construct
  source 1..3810: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggggggcagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgccagcgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 208 - RNA, 3810 nt, synthetic construct; identical to SEQ ID NO: 207
  source 1..3810: mol_type = other RNA

SEQ ID NO: 209 - RNA, 3810 nt, synthetic construct
  source 1..3810: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggtgaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccgggggggagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgccagcgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 210 - RNA, 3816 nt, synthetic construct
  source 1..3816: mol_type = other RNA
atgttcgtgttcctggtcctcctgcccctggtgagctcccagtgcgtgaacttccgcaccggcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcatcgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagcctgatggagtccggcgtctacagctccgccaacaactgcacgttcgagtacgtgagccagcccttcctgatggacctggagggcaagcaggggaacctgaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccacccggttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcgacggcaactacaactaccgctaccgcctgttccgcaagagcaacctcaagcccttcgagcgggacatctccaccgagatctaccaggccggcaacaagccctgcaacggggtggccggccccaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtcagcgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgtgtactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccatcgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 211 - RNA, 3810 nt, synthetic construct
  source 1..3810: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtacaagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 212 - RNA, 3807 nt, synthetic construct
  source 1..3807: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcgggggcaactacaactaccgctaccgcctgttccgcaagagcaacctcaagcccttcgagcgggacatctccaccgagatctaccaggccggcaacaagccctgcaacggggtggccggcgtgaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 213 - RNA, 3807 nt, synthetic construct
  source 1..3807: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcgggggcaactacaactaccgctaccgcctgttccgcaagagcaacctcaagcccttcgagcgggacatctccaccgagatctaccaggccggcaacaagccctgcaacggggtggccggcgtgaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctccttcctgaaggggtgctgcagctgcggctcctgctgcaagttcgacgaggacgacagcgagcccgtcctgaagggggtgaagctccactacacgtga

SEQ ID NO: 214 - RNA, 3813 nt, synthetic construct
  source 1..3813: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacgagaacaacaagagccgcatggagtccgagctgcgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccggtgaacctgggccgggacctgccccaggggttcagcgccctcgagcccctggtggacctgcccatcggcatcaacatcacccgcttccagaccctcctggccctgcaccggtcctacctcacgccgggggacagcagctccagctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaccgtcagcggcaactacaactaccgctaccgcctgttccgcaagagcaagctcaagcccttcgagcgggacatctccaccgagatctaccaggccggcaacaagccctgcaacggggtggccggcagcaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 215 - RNA, 3813 nt, synthetic construct
  source 1..3813: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacgagaacaacaagagccgcatggagtccgagctgcgggtctacagctccgccaacaactgcacgttcgagtacgtgagccagcccttcctgatggacctggagggcaagcagggggacttcaagaacctccgcgagttcgtgttcaagaacatcgacggctacttcaagatctactccaagcacaccccggtgaacctgggccgggacctgccccaggggttcagcgccctcgagcccctggtggacctgcccatcggcatcaacatcacccgcttccagaccctcctggccctgcaccggtcctacctcacgccgggggacagcagctccagctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaccgtcagcggcaactacaactaccgctaccgcctgttccgcaagagcaagctcaagcccttcgagcgggacatctccaccgagatctaccaggccggcaacaagccctgcaacggggtggccggcagcaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 216 - RNA, 3813 nt, synthetic construct
  source 1..3813: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacgagaacaacaagagccgcatggagtccgagctgcgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccggtgaacctgggccgggacctgccccaggggttcagcgccctcgagcccctggtggacctgcccatcggcatcaacatcacccgcttccagaccctcctggccctgcaccggtcctacctcacgccgggggacagcagctccagctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaccgtcagcggcaactacaactaccgctaccgcctgttccgcaagagcaagctcaagcccttcgagcgggacatctccaccgagatctaccaggccggcaacaagccctgcaacggggtggccggcagcaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcatctccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 217 - RNA, 3804 nt, synthetic construct
  source 1..3804: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccggggggcagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaccgtcgggggcaactacaactaccgctaccgcctgttccgcaagagcaagctcaagcccttcgagcgggacatctccaccgagatctaccaggccggcaacaagccctgcaacggggtggccggcgtgaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 218 - RNA, 3810 nt, synthetic construct
  source 1..3810: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccacggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 219 - RNA, 3807 nt, synthetic construct
  source 1..3807: mol_type = other RNA
atgttcgtgttcctggtcctcctgcccctggtgagctcccagtgcgtgaacctcatcacccgcacgcagctgagccccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccacaagaacaacaagagctggatggagtccggcgtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccctgatcaacagcgtccggcacctcccccaggggttcagcgtgctcgagcccctggtggacctgcccatcggcatcaacatcacccgcttccagaccctcctgcaccggtcctacctcacgccgggggacagcagcctgggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccaccagcttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcagcggcaactacaactaccgctaccgcctgttccgcaagagcaacctcaagcccttcgagcgggacatctccaccgagatctaccaggccggcaacaagccctgcaacggggtggccggccccaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagatcagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 220 - RNA, 3810 nt, synthetic construct
  source 1..3810: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccaggtggcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgccagcgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 221 - RNA, 4082 nt, synthetic construct
  source 1..4082: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaccgtcgggggcaactacaactaccgctaccgcctgttccgcaagagcaagctcaagcccttcgagcgggacatctccaccgagatctaccaggccggcaacaagccctgcaacggggtggccggcgtgaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 222 - RNA, 4088 nt, synthetic construct
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggtgggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaaccgcccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 223 - RNA, 4088 nt, synthetic construct
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggtgggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaaccgcccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcatcgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 224 - RNA, 4088 nt, synthetic construct
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcggcacctcccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 225 - RNA, 4088 nt, synthetic construct
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 226 - RNA, 4088 nt, synthetic construct
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggggggcagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgccagcgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 227 - RNA, 4088 nt, synthetic construct
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttctacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccgggggggagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgccagcgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 228 - RNA, 4088 nt, synthetic construct; identical to SEQ ID NO: 227
  source 1..4088: mol_type = other RNA

SEQ ID NO: 229 - RNA, 4094 nt, synthetic construct
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacttccgcaccggcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcatcgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcggcgtgtactaccacaagaacaacaagagcctgatggagtccggcgtctacagctccgccaacaactgcacgttcgagtacgtgagccagcccttcctgatggacctggagggcaagcaggggaacctgaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccacccggttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcgacggcaactacaactaccgctaccgcctgttccgcaagagcaacctcaagcccttcgagcgggacatctccaccgagatctaccaggccggcaacaagccctgcaacggggtggccggccccaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtcagcgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgtgtactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccatcgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 230 - RNA, 4088 nt, synthetic construct
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtacaagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 231 - RNA, 4085 nt, synthetic construct
  source 1..4085: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcgggggcaactacaactaccgctaccgcctgttccgcaagagcaacctcaagcccttcgagcgggacatctccaccgagatctaccaggccggcaacaagccctgcaacggggtggccggcgtgaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 232 - RNA, 4085 nt, synthetic construct
  source 1..4085: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccgggggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcgggggcaactacaactaccgctaccgcctgttccgcaagagcaacctcaagcccttcgagcgggacatctccaccgagatctaccaggccggcaacaagccctgcaacggggtggccggcgtgaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctccttcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 233 - RNA, 4091 nt, synthetic construct
  source 1..4091: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacgagaacaacaagagccgcatggagtccgagctgcgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccggtgaacctgggccgggacctgccccaggggttcagcgccctcgagcccctggtggacctgcccatcggcatcaacatcacccgcttccagaccctcctggccctgcaccggtcctacctcacgccgggggacagcagctccagctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaccgtcagcggcaactacaactaccgctaccgcctgttccgcaagagcaagctcaagcccttcgagcgggacatctccaccgagatctaccaggccggcaacaagccctgcaacggggtggccggcagcaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 234 - RNA, 4091 nt, synthetic construct
  source 1..4091: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacgagaacaacaagagccgcatggagtccgagctgcgggtctacagctccgccaacaactgcacgttcgagtacgtgagccagcccttcctgatggacctggagggcaagcagggggacttcaagaacctccgcgagttcgtgttcaagaacatcgacggctacttcaagatctactccaagcacaccccggtgaacctgggccgggacctgccccaggggttcagcgccctcgagcccctggtggacctgcccatcggcatcaacatcacccgcttccagaccctcctggccctgcaccggtcctacctcacgccgggggacagcagctccagctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaccgtcagcggcaactacaactaccgctaccgcctgttccgcaagagcaagctcaagcccttcgagcgggacatctccaccgagatctaccaggccggcaacaagccctgcaacggggtggccggcagcaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 235 - RNA, 4091 nt, synthetic construct
  source 1..4091: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacgagaacaacaagagccgcatggagtccgagctgcgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccggtgaacctgggccgggacctgccccaggggttcagcgccctcgagcccctggtggacctgcccatcggcatcaacatcacccgcttccagaccctcctggccctgcaccggtcctacctcacgccgggggacagcagctccagctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaccgtcagcggcaactacaactaccgctaccgcctgttccgcaagagcaagctcaagcccttcgagcgggacatctccaccgagatctaccaggccggcaacaagccctgcaacggggtggccggcagcaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcatctccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 236 - RNA, 4082 nt, synthetic construct
  source 1..4082: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatctccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccacaagaacaacaagagctggatggagtccgagttccgggtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccggggggcagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaccgtcgggggcaactacaactaccgctaccgcctgttccgcaagagcaagctcaagcccttcgagcgggacatctccaccgagatctaccaggccggcaacaagccctgcaacggggtggccggcgtgaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 237 - RNA, 4088 nt, synthetic construct
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccacggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 238 - RNA, 4085 nt, synthetic construct
  source 1..4085: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagctgagccccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccacaagaacaacaagagctggatggagtccggcgtctacagctccgccaacaactgcacgttcgagtacgtgagccagcccttcctgatggacctggagggcaagcaggggaacttcaagaacctccgcgagttcgtgttcaagaacatcgacggctacttcaagatctactccaagcacaccctgatcaacagcgtccggcacctcccccaggggttcagcgtgctcgagcccctggtggacctgcccatcggcatcaacatcacccgcttccagaccctcctgcaccggtcctacctcacgccgggggacagcagcctgggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcggcgaggtgttcaacgccaccagcttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcagcggcaactacaactaccgctaccgcctgttccgcaagagcaacctcaagcccttcgagcgggacatctccaccgagatctaccaggccggcaacaagccctgcaacggggtggccggccccaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagatcagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 239 - RNA, 4088 nt, synthetic construct
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccaggtggcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgccagcgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 240 - RNA, 4082 nt, synthetic construct; identical to SEQ ID NO: 221
  source 1..4082: mol_type = other RNA
  modified_base 1..4082: mod_base = m1f

SEQ ID NO: 241 - RNA, 4088 nt, synthetic construct; identical to SEQ ID NO: 222
  source 1..4088: mol_type = other RNA
  modified_base 1..4088: mod_base = m1f

SEQ ID NO: 242 - RNA, 4088 nt, synthetic construct; identical to SEQ ID NO: 223
  source 1..4088: mol_type = other RNA
  modified_base 1..4088: mod_base = m1f

SEQ ID NO: 243 - RNA, 4088 nt, synthetic construct; identical to SEQ ID NO: 224
  source 1..4088: mol_type = other RNA
  modified_base 1..4088: mod_base = m1f

SEQ ID NO: 244 - RNA, 4088 nt, synthetic construct; identical to SEQ ID NO: 225
  source 1..4088: mol_type = other RNA
  modified_base 1..4088: mod_base = m1f

SEQ ID NO: 245 - RNA, 4088 nt, synthetic construct; identical to SEQ ID NO: 226
  source 1..4088: mol_type = other RNA
  modified_base 1..4088: mod_base = m1f

SEQ ID NO: 246 - RNA, 4088 nt, synthetic construct; identical to SEQ ID NO: 227
  source 1..4088: mol_type = other RNA
  modified_base 1..4088: mod_base = m1f

SEQ ID NO: 247 - RNA, 4088 nt, synthetic construct
  source 1..4088: mol_type = other RNA
  modified_base 1..4088: mod_base = m1f
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggtgaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccgggggggagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgccagcgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 248 - RNA, 4094 nt, synthetic construct; identical to SEQ ID NO: 229
  source 1..4094: mol_type = other RNA
  modified_base 1..4094: mod_base = m1f

SEQ ID NO: 249 - RNA, 4088 nt, synthetic construct; identical to SEQ ID NO: 230
  source 1..4088: mol_type = other RNA
  modified_base 1..4088: mod_base = m1f

SEQ ID NO: 250 - RNA, 4085 nt, synthetic construct; identical to SEQ ID NO: 231
  source 1..4085: mol_type = other RNA
  modified_base 1..4085: mod_base = m1f

SEQ ID NO: 251 - RNA, 4085 nt, synthetic construct; identical to SEQ ID NO: 232
  source 1..4085: mol_type = other RNA
  modified_base 1..4085: mod_base = m1f

SEQ ID NO: 252 - RNA, 4091 nt, synthetic construct; identical to SEQ ID NO: 233
  source 1..4091: mol_type = other RNA
  modified_base 1..4091: mod_base = m1f

SEQ ID NO: 253 - RNA, 4091 nt, synthetic construct; identical to SEQ ID NO: 234
  source 1..4091: mol_type = other RNA
  modified_base 1..4091: mod_base = m1f

SEQ ID NO: 254 - RNA, 4091 nt, synthetic construct; identical to SEQ ID NO: 235
  source 1..4091: mol_type = other RNA
  modified_base 1..4091: mod_base = m1f

SEQ ID NO: 255 - RNA, 4082 nt, synthetic construct; identical to SEQ ID NO: 236
  source 1..4082: mol_type = other RNA
  modified_base 1..4082: mod_base = m1f

SEQ ID NO: 256 - RNA, 4088 nt, synthetic construct; identical to SEQ ID NO: 237
  source 1..4088: mol_type = other RNA
  modified_base 1..4088: mod_base = m1f

SEQ ID NO: 257 - RNA, 4085 nt, synthetic construct; identical to SEQ ID NO: 238
  source 1..4085: mol_type = other RNA
  modified_base 1..4085: mod_base = m1f

SEQ ID NO: 258 - RNA, 4088 nt, synthetic construct; identical to SEQ ID NO: 239
  source 1..4088: mol_type = other RNA
  modified_base 1..4088: mod_base = m1f

SEQ ID NO: 259 - RNA, 3810 nt, synthetic construct
  source 1..3810: mol_type = other RNA
atgttcgtgttcctggtgctgctgcctctggtgtccagccagtgtgtgaacctgatcaccagaacacagtcatacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgccctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctggacgtctaccagaagaacaacaagagctggatggaaagcgagttccgggtgtacagcagcgccaacaactgcaccttcgagtacgtgtcccagcctttcctgatggacctggaaggcaaggagggcaacttcaagaacctgcgcgagttcgtgtttaagaacatcgacggctacttcaagatctacagcaagcacacccctatcaacctcgagcgggatctgcctcagggcttctctgctctggaacccctggtggatctgcccatcggcatcaacatcacccggtttcagacactgctggccctgcacagaagctacctgacacctgtggatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttccacgaggtgttcaatgccaccaccttcgcctctgtgtacgcctggaaccggaagcggatcagcaattgcgtggccgactactccgtgatctacaacttcgcccccttcttcgcattcaagtgctacggcgtgtcccctaccaagctgaacgacctgtgcttcacaaacgtgtacgccgacagcttcgtgatccggggaaacgaagtgtcacagattgcccctggacagacaggcaacatcgccgactacaactacaagctgcccgacgacttcaccggctgtgtgattgcctggaacagcaacaagctggactccaaacccagcggcaactacaattacctgtaccggctgttccggaagtccaagctgaagcccttcgagcgggacatctccaccgagatctatcaggccggcaacaagccttgtaacggcgtggcaggccccaactgctacagcccactgcagtcctacggctttaggcccacatacggcgtgggccaccagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaagagccaccggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaaaagagccctgacagggatcgccgtggaacaggacaagaacacccaagaggtgttcgcccaagtgaagcagatctacaagacccctcctatcaagtacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccacaatgcccaggcactgaacaccctggtcaagcagctgtcctccaagttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatga

SEQ ID NO: 260 - RNA, 4272 nt, synthetic construct
  source 1..4272: mol_type = other RNA
  modified_base 1..4272: mod_base = m1f
gagaataaactagtattcttctggtccccacagactcagagagaacccgccaccatgttcgtgttcctggtgctgctgcctctggtgtccagccagtgtgtgaacctgatcaccagaacacagtcatacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgccctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctggacgtctaccagaagaacaacaagagctggatggaaagcgagttccgggtgtacagcagcgccaacaactgcaccttcgagtacgtgtcccagcctttcctgatggacctggaaggcaaggagggcaacttcaagaacctgcgcgagttcgtgtttaagaacatcgacggctacttcaagatctacagcaagcacacccctatcaacctcgagcgggatctgcctcagggcttctctgctctggaacccctggtggatctgcccatcggcatcaacatcacccggtttcagacactgctggccctgcacagaagctacctgacacctgtggatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttccacgaggtgttcaatgccaccaccttcgcctctgtgtacgcctggaaccggaagcggatcagcaattgcgtggccgactactccgtgatctacaacttcgcccccttcttcgcattcaagtgctacggcgtgtcccctaccaagctgaacgacctgtgcttcacaaacgtgtacgccgacagcttcgtgatccggggaaacgaagtgtcacagattgcccctggacagacaggcaacatcgccgactacaactacaagctgcccgacgacttcaccggctgtgtgattgcctggaacagcaacaagctggactccaaacccagcggcaactacaattacctgtaccggctgttccggaagtccaagctgaagcccttcgagcgggacatctccaccgagatctatcaggccggcaacaagccttgtaacggcgtggcaggccccaactgctacagcccactgcagtcctacggctttaggcccacatacggcgtgggccaccagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaagagccaccggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaaaagagccctgacagggatcgccgtggaacaggacaagaacacccaagaggtgttcgcccaagtgaagcagatctacaagacccctcctatcaagtacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccacaatgcccaggcactgaacaccctggtcaagcagctgtcctccaagttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgatgactcgagctggtactgcatgcacgcaatgctagctgcccctttcccgtcctgggtaccccgagtctcccccgacctcgggtcccaggtatgctcccacctccacctgccccactcaccacctctgctagttccagacacctcccaagcacgcagcaatgcagctcaaaacgcttagcctagccacacccccacgggaaacagcagtgattaacctttagcaataaacgaaagtttaactaagctatactaaccccagggttggtcaatttcgtgccagccacaccctggagctagcaaaaaaaaaaaaaaaaaaaaaaaaaaaaaagcatatgactaaaaaaaaaaaaaaaaaaaaaaaaaaaaaaaaaaaaaaaaaaaaaaaaaaaaaaaaaaaaaaaaaaaaaa

SEQ ID NO: 261 - RNA, 4271 nt, synthetic construct
  source 1..4271: mol_type = other RNA
  modified_base 1..4271: mod_base = m1f
agaataaactagtattcttctggtccccacagactcagagagaacccgccaccatgttcgtgttcctggtgctgctgcctctggtgtccagccagtgtgtgaacctgatcaccagaacacagtcatacaccaacagctttaccagaggcgtgtactaccccgacaaggtgttcagatccagcgtgctgcactctacccaggacctgttcctgcctttcttcagcaacgtgacctggttccacgccatccacgtgtccggcaccaatggcaccaagagattcgacaaccccgccctgcccttcaacgacggggtgtactttgccagcaccgagaagtccaacatcatcagaggctggatcttcggcaccacactggacagcaagacccagagcctgctgatcgtgaacaacgccaccaacgtggtcatcaaagtgtgcgagttccagttctgcaacgaccccttcctggacgtctaccagaagaacaacaagagctggatggaaagcgagttccgggtgtacagcagcgccaacaactgcaccttcgagtacgtgtcccagcctttcctgatggacctggaaggcaaggagggcaacttcaagaacctgcgcgagttcgtgtttaagaacatcgacggctacttcaagatctacagcaagcacacccctatcaacctcgagcgggatctgcctcagggcttctctgctctggaacccctggtggatctgcccatcggcatcaacatcacccggtttcagacactgctggccctgcacagaagctacctgacacctgtggatagcagcagcggatggacagctggtgccgccgcttactatgtgggctacctgcagcctagaaccttcctgctgaagtacaacgagaacggcaccatcaccgacgccgtggattgtgctctggatcctctgagcgagacaaagtgcaccctgaagtccttcaccgtggaaaagggcatctaccagaccagcaacttccgggtgcagcccaccgaatccatcgtgcggttccccaatatcaccaatctgtgccccttccacgaggtgttcaatgccaccaccttcgcctctgtgtacgcctggaaccggaagcggatcagcaattgcgtggccgactactccgtgatctacaacttcgcccccttcttcgcattcaagtgctacggcgtgtcccctaccaagctgaacgacctgtgcttcacaaacgtgtacgccgacagcttcgtgatccggggaaacgaagtgtcacagattgcccctggacagacaggcaacatcgccgactacaactacaagctgcccgacgacttcaccggctgtgtgattgcctggaacagcaacaagctggactccaaacccagcggcaactacaattacctgtaccggctgttccggaagtccaagctgaagcccttcgagcgggacatctccaccgagatctatcaggccggcaacaagccttgtaacggcgtggcaggccccaactgctacagcccactgcagtcctacggctttaggcccacatacggcgtgggccaccagccctacagagtggtggtgctgagcttcgaactgctgcatgcccctgccacagtgtgcggccctaagaaaagcaccaatctcgtgaagaacaaatgcgtgaacttcaacttcaacggcctgaccggcaccggcgtgctgacagagagcaacaagaagttcctgccattccagcagtttggccgggatatcgccgataccacagacgccgttagagatccccagacactggaaatcctggacatcaccccttgcagcttcggcggagtgtctgtgatcacccctggcaccaacaccagcaatcaggtggcagtgctgtaccagggcgtgaactgtaccgaagtgcccgtggccattcacgccgatcagctgacacctacatggcgggtgtactccaccggcagcaatgtgtttcagaccagagccggctgtctgatcggagccgagtacgtgaacaatagctacgagtgcgacatccccatcggcgctggaatctgcgccagctaccagacacagacaaagagccaccggagagccagaagcgtggccagccagagcatcattgcctacacaatgtctctgggcgccgagaacagcgtggcctactccaacaactctatcgctatccccaccaacttcaccatcagcgtgaccacagagatcctgcctgtgtccatgaccaagaccagcgtggactgcaccatgtacatctgcggcgattccaccgagtgctccaacctgctgctgcagtacggcagcttctgcacccagctgaaaagagccctgacagggatcgccgtggaacaggacaagaacacccaagaggtgttcgcccaagtgaagcagatctacaagacccctcctatcaagtacttcggcggcttcaatttcagccagattctgcccgatcctagcaagcccagcaagcggagcttcatcgaggacctgctgttcaacaaagtgacactggccgacgccggcttcatcaagcagtatggcgattgtctgggcgacattgccgccagggatctgatttgcgcccagaagtttaacggactgacagtgctgcctcctctgctgaccgatgagatgatcgcccagtacacatctgccctgctggccggcacaatcacaagcggctggacatttggagcaggcgccgctctgcagatcccctttgctatgcagatggcctaccggttcaacggcatcggagtgacccagaatgtgctgtacgagaaccagaagctgatcgccaaccagttcaacagcgccatcggcaagatccaggacagcctgagcagcacagcaagcgccctgggaaagctgcaggacgtggtcaaccacaatgcccaggcactgaacaccctggtcaagcagctgtcctccaagttcggcgccatcagctctgtgctgaacgatatcctgagcagactggaccctcctgaggccgaggtgcagatcgacagactgatcacaggcagactgcagagcctccagacatacgtgacccagcagctgatcagagccgccgagattagagcctctgccaatctggccgccaccaagatgtctgagtgtgtgctgggccagagcaagagagtggacttttgcggcaagggctaccacctgatgagcttccctcagtctgcccctcacggcgtggtgtttctgcacgtgacatatgtgcccgctcaagagaagaatttcaccaccgctccagccatctgccacgacggcaaagcccactttcctagagaaggcgtgttcgtgtccaacggcacccattggttcgtgacacagcggaacttctacgagccccagatcatcaccaccgacaacaccttcgtgtctggcaactgcgacgtcgtgatcggcattgtgaacaataccgtgtacgaccctctgcagcccgagctggacagcttcaaagaggaactggacaagtactttaagaaccacacaagccccgacgtggacctgggcgatatcagcggaatcaatgccagcgtcgtgaacatccagaaagagatcgaccggctgaacgaggtggccaagaatctgaacgagagcctgatcgacctgcaagaactggggaagtacgagcagtacatcaagtggccctggtacatctggctgggctttatcgccggactgattgccatcgtgatggtcacaatcatgctgtgttgcatgaccagctgctgtagctgcctgaagggctgttgtagctgtggcagctgctgcaagttcgacgaggacgattctgagcccgtgctgaagggcgtgaaactgcactacacatgatgactcgagctggtactgcatgcacgcaatgctagctgcccctttcccgtcctgggtaccccgagtctcccccgacctcgggtcccaggtatgctcccacctccacctgccccactcaccacctctgctagttccagacacctcccaagcacgcagcaatgcagctcaaaacgcttagcctagccacacccccacgggaaacagcagtgattaacctttagcaataaacgaaagtttaactaagctatactaaccccagggttggtcaatttcgtgccagccacaccctggagctagcaaaaaaaaaaaaaaaaaaaaaaaaaaaaaagcatatgactaaaaaaaaaaaaaaaaaaaaaaaaaaaaaaaaaaaaaaaaaaaaaaaaaaaaaaaaaaaaaaaaaaaaaa

SEQ ID NO: 262 - RNA, 3810 nt, synthetic construct
  source 1..3810: mol_type = other RNA
atgttcgtgttcctggtgctgctgcccctggtgagcagccagtgcgtgaacctgatcacccggacccagagctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgccctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctggacgtgtaccagaagaacaacaagagctggatggagagcgagttccgggtgtacagcagcgccaacaactgcaccttcgagtacgtgagccagcccttcctgatggacctggagggcaaggagggcaacttcaagaacctgcgggagttcgtgttcaagaacatcgacggctacttcaagatctacagcaagcacaccccaatcaacctggagcgggatctgccccagggcttctcagccctggagcccctggtggacctgcccatcggcatcaacatcacccggttccagaccctgctggccctgcaccggagctacctgaccccagtggacagcagcagcgggtggacagcaggcgcggctgcttactacgtgggctacctgcagccccggaccttcctgctgaagtacaacgagaacggcaccatcaccgacgccgtggactgcgccctggaccctctgagcgagactaagtgcaccctgaagagcttcaccgtggagaagggcatctaccagaccagcaacttccgggtgcagcccaccgagagcatcgtgcggttccccaacatcaccaacctgtgccccttccacgaggtgttcaacgccaccaccttcgccagcgtgtacgcctggaaccggaagcggatcagcaactgcgtggccgactacagcgtgatctacaacttcgccccattcttcgccttcaagtgctacggcgtgagccccaccaagctgaacgacctgtgcttcaccaacgtgtacgccgacagcttcgtgatccgtggcaacgaggtgagccagatcgcacccggccagacaggcaacatcgccgactacaactacaagctgcccgacgacttcaccggctgcgtgatcgcctggaacagcaacaagctcgacagcaagcccagcggcaactacaactacctgtaccggctgttccggaagagcaagctgaagcccttcgagcgggacatcagcaccgagatctaccaagccggcaacaagccttgcaacggcgtggccggccccaactgctacagccctctgcagagctacggcttccggcccacctacggcgtgggccaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagtacgtgaacaacagctacgagtgcgacatccccatcggcgccggcatctgtgccagctaccagacccagaccaagtcacaccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaagcgggccctgaccggcatcgccgtggagcaggacaagaacacccaggaggtgttcgcccaggtgaagcagatctacaagacccctcccatcaagtacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccacaacgcccaggccctgaacaccctggtgaagcagctgagcagcaagttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctga

SEQ ID NO: 263 - RNA, 4101 nt, synthetic construct
  source 1..4101: mol_type = other RNA
  modified_base 1..4101: mod_base = m1f
gggaaataagagagaaaagaagagtaagaagaaatataagaccccggcgccgccaccatgttcgtgttcctggtgctgctgcccctggtgagcagccagtgcgtgaacctgatcacccggacccagagctacaccaacagcttcacccggggcgtctactaccccgacaaggtgttccggagcagcgtcctgcacagcacccaggacctgttcctgcccttcttcagcaacgtgacctggttccacgccatccacgtgagcggcaccaacggcaccaagcggttcgacaaccccgccctgcccttcaacgacggcgtgtacttcgccagcaccgagaagagcaacatcatccggggctggatcttcggcaccaccctggacagcaagacccagagcctgctgatcgtgaataacgccaccaacgtggtgatcaaggtgtgcgagttccagttctgcaacgaccccttcctggacgtgtaccagaagaacaacaagagctggatggagagcgagttccgggtgtacagcagcgccaacaactgcaccttcgagtacgtgagccagcccttcctgatggacctggagggcaaggagggcaacttcaagaacctgcgggagttcgtgttcaagaacatcgacggctacttcaagatctacagcaagcacaccccaatcaacctggagcgggatctgccccagggcttctcagccctggagcccctggtggacctgcccatcggcatcaacatcacccggttccagaccctgctggccctgcaccggagctacctgaccccagtggacagcagcagcgggtggacagcaggcgcggctgcttactacgtgggctacctgcagccccggaccttcctgctgaagtacaacgagaacggcaccatcaccgacgccgtggactgcgccctggaccctctgagcgagactaagtgcaccctgaagagcttcaccgtggagaagggcatctaccagaccagcaacttccgggtgcagcccaccgagagcatcgtgcggttccccaacatcaccaacctgtgccccttccacgaggtgttcaacgccaccaccttcgccagcgtgtacgcctggaaccggaagcggatcagcaactgcgtggccgactacagcgtgatctacaacttcgccccattcttcgccttcaagtgctacggcgtgagccccaccaagctgaacgacctgtgcttcaccaacgtgtacgccgacagcttcgtgatccgtggcaacgaggtgagccagatcgcacccggccagacaggcaacatcgccgactacaactacaagctgcccgacgacttcaccggctgcgtgatcgcctggaacagcaacaagctcgacagcaagcccagcggcaactacaactacctgtaccggctgttccggaagagcaagctgaagcccttcgagcgggacatcagcaccgagatctaccaagccggcaacaagccttgcaacggcgtggccggccccaactgctacagccctctgcagagctacggcttccggcccacctacggcgtgggccaccagccctaccgggtggtggtgctgagcttcgagctgctgcacgccccagccaccgtgtgtggccccaagaagagcaccaacctggtgaagaacaagtgcgtgaacttcaacttcaacggccttaccggcaccggcgtgctgaccgagagcaacaagaaattcctgccctttcagcagttcggccgggacatcgccgacaccaccgacgctgtgcgggatccccagaccctggagatcctggacatcaccccttgcagcttcggcggcgtgagcgtgatcaccccaggcaccaacaccagcaaccaggtggccgtgctgtaccagggcgtgaactgcaccgaggtgcccgtggccatccacgccgaccagctgacacccacctggcgggtctacagcaccggcagcaacgtgttccagacccgggccggttgcctgatcggcgccgagtacgtgaacaacagctacgagtgcgacatccccatcggcgccggcatctgtgccagctaccagacccagaccaagtcacaccggagggcaaggagcgtggccagccagagcatcatcgcctacaccatgagcctgggcgccgagaacagcgtggcctacagcaacaacagcatcgccatccccaccaacttcaccatcagcgtgaccaccgagattctgcccgtgagcatgaccaagaccagcgtggactgcaccatgtacatctgcggcgacagcaccgagtgcagcaacctgctgctgcagtacggcagcttctgcacccagctgaagcgggccctgaccggcatcgccgtggagcaggacaagaacacccaggaggtgttcgcccaggtgaagcagatctacaagacccctcccatcaagtacttcggcggcttcaacttcagccagatcctgcccgaccccagcaagcccagcaagcggagcttcatcgaggacctgctgttcaacaaggtgaccctagccgacgccggcttcatcaagcagtacggcgactgcctcggcgacatagccgcccgggacctgatctgcgcccagaagttcaacggcctgaccgtgctgcctcccctgctgaccgacgagatgatcgcccagtacaccagcgccctgttagccggaaccatcaccagcggctggactttcggcgctggagccgctctgcagatccccttcgccatgcagatggcctaccggttcaacggcatcggcgtgacccagaacgtgctgtacgagaaccagaagctgatcgccaaccagttcaacagcgccatcggcaagatccaggacagcctgagcagcaccgctagcgccctgggcaagctgcaggacgtggtgaaccacaacgcccaggccctgaacaccctggtgaagcagctgagcagcaagttcggcgccatcagcagcgtgctgaacgacatcctgagccggctggaccctcccgaggccgaggtgcagatcgaccggctgatcactggccggctgcagagcctgcagacctacgtgacccagcagctgatccgggccgccgagattcgggccagcgccaacctggccgccaccaagatgagcgagtgcgtgctgggccagagcaagcgggtggacttctgcggcaagggctaccacctgatgagctttccccagagcgcaccccacggagtggtgttcctgcacgtgacctacgtgcccgcccaggagaagaacttcaccaccgccccagccatctgccacgacggcaaggcccactttccccgggagggcgtgttcgtgagcaacggcacccactggttcgtgacccagcggaacttctacgagccccagatcatcaccaccgacaacaccttcgtgagcggcaactgcgacgtggtgatcggcatcgtgaacaacaccgtgtacgatcccctgcagcccgagctggacagcttcaaggaggagctggacaagtacttcaagaatcacaccagccccgacgtggacctgggcgacatcagcggcatcaacgccagcgtggtgaacatccagaaggagatcgatcggctgaacgaggtggccaagaacctgaacgagagcctgatcgacctgcaggagctgggcaagtacgagcagtacatcaagtggccctggtacatctggctgggcttcatcgccggcctgatcgccatcgtgatggtgaccatcatgctgtgctgcatgaccagctgctgcagctgcctgaagggctgttgcagctgcggcagctgctgcaagttcgacgaggacgacagcgagcccgtgctgaagggcgtgaagctgcactacacctgataataggctggagcctcggtggcctagcttcttgccccttgggcctccccccagcccctcctccccttcctgcaaagagaaagaaataaagaaagaaagtggtctttgaataaagtctgagtgggcggcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaatctag

SEQ ID NO: 264 - protein, 1269 aa, synthetic construct
MFVFLVLLPLVSSQCVNLITRTQSYTNSFTRGVYYPDKVFRSSVLHSTHDLFLPFFSNVTWFHAIHVSGTNGTKRFDNPALPFNDGVYFASTEKSNIIRGWIFGTTLDSKTQSLLIVNNATNVVIKVCEFQFCNDPFLDVYQKNNKSWMESEFRVYSSANNCTFEYVSQPFLMDLEGKEGNFKNLREFVFKNIDGYFKIYSKHTPINLERDLPQGFSALEPLVDLPIGINITRFQTLLALHRSYLTPVDSSSGWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVIYNFAPFFAFKCYGVSPTKLNDLCFTNVYADSFVIRGNEVSQIAPGQTGNIADYNYKLPDDFTGCVIAWNSNKLDSKPSGNYNYLYRLLRKSKLKPFERDISTEIYQAGNKPCNGVAGPNCYSPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 265 - protein, 1269 aa, synthetic construct
MFVFLVLLPLVSSQCVNLITRTQSYTNSFTRGVYYPDKVFRSSVLHSTQDLFLPFFSNVTWFHAIHVSGTNGTKRFDNPALPFNDGVYFASTEKSNIIRGWIFGTTLDSKTQSLLIVNNATNVVIKVCEFQFCNDPFLDVYQKNNKSWMESEFRVYSSANNCTFEYVSQPFLMDLEGKEGNFKNLREFVFKNIDGYFKIYSKHTPINLERDLPQGFSALEPLVDLPIGINITRFQTLLALHRSYLTPVDSSSGWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVIYNFAPFFAFKCYGVSPTKLNDLCFTNVYADSFVIRGNEVSQIAPGQTGNIADYNYKLPDDFTGCVIAWNSNKLDSKPSGNYNYLYRLLRKSKLKPFERDISTEIYQAGNKPCNGVAGPNCYSPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 266 - protein, 1269 aa, synthetic construct
MFVFLVLLPLVSSQCVNLITRTQSYTNSFTRGVYYPDKVFRSSVLHSTQDLFLPFFSNVTWFHAIHVSGTNGTKRFDNPALPFNDGVYFASTEKSNIIRGWIFGTTLDSKTQSLLIVNNATNVVIKVCEFQFCNDPFLDVYQKNNKSWMESEFRVYSSANNCTFEYVSQPFLMDLEGNEGNFKNLREFVFKNIDGYFKIYSKHTPINLERDLPQGFSALEPLVDLPIGINITRFQTLLALHRSYLTPGGSSSGWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVIYNFAPFFAFKCYGVSPTKLNDLCFTNVYADSFVIRGNEVSQIAPGQTGNIADYNYKLPDDFTGCVIAWNSNKLDSKPSGNYNYLYRLFRKSKLKPFERDISTEIYQAGNKPCNGVAGPNCYSPLQSYGFRPTYGVGHQPYRVVVLSFELLHASATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 267 - protein, 1269 aa, synthetic construct
MFVFLVLLPLVSSQCVNLITRTQSYTNSFTRGVYYPDKVFRSSVLHSTQDLFLPFFSNVTWFHAIHVSGTNGTKRFDNPALPFNDGVYFASTEKSNIIRGWIFGTTLDSKTQSLLIVNNATNVVIKVCEFQFCNDPFLDVYQKNNKSWMESEFRVYSSANNCTFEYVSQPFLMDLEGKEGNFKNLREFVFKNIDGYFKIYSKHTPINLERDLPQGFSALEPLVDLPIGINITRFQTLLALHRSYLTPGGSSSGWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVIYNFAPFFAFKCYGVSPTKLNDLCFTNVYADSFVIRGNEVSQIAPGQTGNIADYNYKLPDDFTGCVIAWNSNKLDSKPSGNYNYLYRLFRKSKLKPFERDISTEIYQAGNQPCNGVAGPNCYSPLQSYGFRPTYGVGHQPYRVVVLSFELLHASATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 268 - protein, 1269 aa, synthetic construct
MFVFLVLLPLVSSQCVNLITRTQSYTNSFTRGVYYPDKVFRSSVLHSTQDLFLPFFSNVTWFHAIHVSGTNGTKRFDNPALPFNDGVYFASTEKSNIIRGWIFGTTLDSKTQSLLIVNNATNVVIKVCEFQFCNDPFLDVYQKNNKSWMESEFRVYSSANNCTFEYVSQPFLMDLEGKEGNFKNLREFVFKNIDGYFKIYSKHTPINLERDLPQGFSALEPLVDLPIGINITRFQTLLALHRSYLTPVDSSSGWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVIYNFAPFFAFKCYGVSPTKLNDLCFTNVYADSFVIRGNEVSQIAPGQTGNIADYNYKLPDDFTGCVIAWNSNKLDSKPSGNYNYLYRLFRKSKLKPFERDISTEIYQAGNKPCNGVAGPNCYSPLQSYGFRPTYGVGHQPYRVVVLSFELVHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 269 - protein, 1269 aa, synthetic construct
MFVFLVLLPLVSSQCVNLITRTQSYTNSFTRGVYYPDKVFRSSVLHSTQDLFLPFFSNVTWFHAIHVSGTNGTKRFDNPALPFNDGVYFASTEKSNIIRGWIFGTTLDSKTQSLLIVNNATNVVIKVCEFQFCNDPFLDVYQKNNKSWMESEFRVYSSANNCTFEYVSQPFLMDLEGKEGNFKNLREFVFKNIDGYFKIYSKHTPINLERDLPQGFSALEPLVDLPIGINITRFQTLLALHRSYLTPVDSSSGWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVIYNFAPFFAFKCYGVSPTKLNDLCFTNVYADSFVIRGNEVSQIAPGQTGNIADYNYKLPDDFTGCVIAWNSNKLDSKPSGNYNYLYRLFRKSKLKPFERDISTEIYQAGNKPCNGVAGPNCYSPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGVENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 270 - protein, 1270 aa, synthetic construct
MFVFLVLLPLVSSQCVNLITRTQSYTNSFTRGVYYPDKVFRSSVLHSTQDLFLPFFSNVTWFHAIHVSGTNGTKRFDNPVLPFNDGVYFASTEKSNIIRGWIFGTTLDSKTQSLLIVNNATNVVIKVCEFQFCNDPFLDVYYHNNNKSWTESEFRVYSSAKNCTFEYVSQPFLMDLEGKQGNFKNLREFVFKNIDGYFKIYSKHTPINLGRDLPQGFSALEPLVDLPIGINITRFQTLLALNRSYLTPGDSSSDWTAGAAAYYVGYLQPRTFLLKYNENGTITDAVDCALDPLSETKCTLKSFTVEKGIYQTSNFRVQPTESIVRFPNITNLCPFDEVFNATTFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSRVSGNYDYMYRLFRKSKLKPFERDISTEIYQAGNKPCNGVRGSNCYFPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 271 - protein, 1269 aa, synthetic construct
MFVFLVLLPLVSSQCVNLITRTQSYTNSFTRGVYYPDKVFRSSVLHSTQDLFLPFFSNVTWFHAIHVSGTNGTKRFDNPALPFNDGVYFASTEKSNIIRGWIFGTTLDSKTQSLLIVNNATNVVIKVCEFQFCNDPFLDVYQKNNKSWMESEFRVYSSANNCTFEYVSQPFLMDLVGKEGNFKNLREFVFKNIDGYFKIYSKHTPINLERDLPQGFSALEPLVDLPIGINITRFQTLLALHRSYLTPVDSSSGWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVIYNFAPFFAFKCYGVSPTKLNDLCFTNVYADSFVIRGNEVSQIAPGQTGNIADYNYKLPDDFTGCVIAWNSNKLDSKPSGNYNYLYRLLRKSKLKPFERDISTEIYQAGNRPCNGVAGPNCYSPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 272 - protein, 1269 aa, synthetic construct
MFVFLVLLPLVSSQCVNLITRTQSYTNSFTRGVYYPDKVFRSSVLHSTQDLFLPFFSNVTWFHAIHVSGTNGTKRFDNPALPFNDGVYFASTEKSNIIRGWIFGTTLDSKTQSLLIVNNATNVVIKVCEFQFCNDPFLDVYQKNNKSWMESEFRVYSSANNCTFEYVSQPFLMDLEGKEGNFKNLREFVFKNIDGYFKIYSKHTPINLERDLPQGFSALEPLVDLPIGINITRFQTLLALHRSYLTPVDSSSGWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVIYNFAPFFAFKCYGVSPTKLNDLCFTNVYADSFVIRGNEVSQIAPGQTGNIADYNYKLPDDFTGCVIAWNSNKLDSKPSGNYNYLYRLFRKSKLKPFERDISTEIYQAGNKPCNGVAGPNCYSPLQSYGFRPTYGVGHQPYRVVVLSFELLHAPATVCGPKKSTNLVKNKCVNFNFNGLTGTGVLTKSNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 273 - protein, 1269 aa, synthetic construct
MFVFLVLLPLVSSQCVNLITRTQSYTNSFTRGVYYPDKVFRSSVLHSTQDLFLPFFSNVTWFHAIHVSGTNGTKRFDNPALPFNDGVYFASTEKSNIIRGWIFGTTLDSKTQSLLIVNNATNVVIKVCEFQFCNDPFLDVYQKNNKSWMESEFRVYSSANNCTFEYVSQPFLMDLEGKEGNFKNLREFVFKNIDGCFKIYSKHTPINLERDLPQGFSALEPLVDLPIGINITRFQTLLALHRSYLTPVDSSSGWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVIYNFAPFFAFKCYGVSPTKLNDLCFTNVYADSFVIRGNEVSQIAPGQTGNIADYNYKLPDDFTGCVIAWNSNKLDSKPSGNYNYLYRLFRKSKLKPFERDISTEIYQAGNKPCNGVAGPNCYSPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 274 - protein, 1269 aa, synthetic construct
MFVFLVLLPLVSSQCVNLITRTQSYTNSFTRGVYYPDKVFRSSVLHSTQDLFLPFFSNVTWFHAIHVSGTNGTKRFDNPALPFNDGVYFASTEKSNIIRGWIFGTTLDSKTQSLLIVNNATNVVIKVCEFQFCNDPFLDVYQKNNKSWMESEFRVYSSANNCTFEYVSQPFLMDLEGKEGNFKNLREFVFKNIDGYFKIYSKHTPINLERDLPQGFSALEPLVDLPIGINITRFQTLLALHRSYLTPVDSSSGWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRKRISNCVADYSVIYNFAPFFAFKCYGVSPTKLNDLCFTNVYADSFVIRGNEVSQIAPGQTGNIADYNYKLPDDFTGCVIAWNSNKLDSKPSGNYNYLYRLFRKSKLKPFERDISTEIYQAGNKPCNGVAGPNCYSPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYHTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 275 - protein, 1271 aa, synthetic construct
MFVFLVLLPLVSSQCVNFRTGTQLPPAYTNSFTRGVYYPDKVFRSSVLHSTQDLFLPFFSNVTWFHAIHVSGTNGTKRFDNPVLPFNDGVYFASIEKSNIIRGWIFGTTLDSKTQSLLIVNNATNVVIKVCEFQFCNDPFLDVYYHKNNKSLMESGVYSSANNCTFEYVSQPFLMDLEGKQGNLKNLREFVFKNIDGYFKIYSKHTPINLGRDLPQGFSALEPLVDLPIGINITRFQTLLALHRSYLTPGGSSSGWTAGAAAYYVGYLQPRTFLLKYNENGTITDAVDCALDPLSETKCTLKSFTVEKGIYQTSNFRVQPTESIVRFPNITNLCPFDEVFNATTFASVYAWNRKRISNCVADYSVLYNFAPFFAFKCYGVSPTKLNDLCFTNVYADSFVIRGNEVSQIAPGQTGNIADYNYKLPDDFTGCVIAWNSNKLDSKVDGNYNYRYRLFRKSNLKPFERDISTEIYQAGNKPCNGVAGPNCYFPLQSYGFRPTYGVGHQPYRVVVLSFELLHAPATVCGPKKSTNLVKNKCVNFNFNGLTGTGVLTESNKKFLPFQQFGRDIADTTDAVRDPQTLEILDITPCSFGGVSVITPGTNTSNQVAVLYQGVNCTEVSVAIHADQLTPTWRVYSTGSNVFQTRAGCLIGAEYVNNSYECDIPIGAGICASYQTQTKSHRRARSVASQSIIAYTMSLGAENSVVYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITIDNTFVSGNCDVVIGIVNNTVYDPLQPELDSFKEELYKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 276 - protein, 1269 aa, synthetic construct
MFVFLVLLPLVSSQCVNLITRTQSYTNSFTRGVYYPDKVFRSSVLHSTQDLFLPFFSNVTWFHAIHVSGTNGTKRFDNPALPFNDGVYFASTEKSNIIRGWIFGTTLDSKTQSLLIVNNATNVVIKVCEFQFCNDPFLDVYQKNNKSWMESEFRVYSSANNCTFEYVSQPFLMDLEGKEGNFKNLREFVFKNIDGYFKIYSKHTPINLERDLPQGFSALEPLVDLPIGINITRFQTLLALHRSYLTPVDSSSGWTAGAAAYYVGYLQPRTFLLKYNENGTITDAVDCALDPLSETKCTLKSFTVEKGIYQTSNFRVQPTESIVRFPNITNLCPFHEVFNATTFASVYAWNRTRISNCVADYSVIYNFAPFFAFKCYGVSPTKLNDLCFTNVYADSFVIRGNEVSQIAPGQTGNIADYNYKLPDDFTGCVIAWNSNKLDSKPSGNYNYLYRLFRKSKLKPFERDISTEIYQAGNKPCNGVAGPNCYSPLQSYGFRPTYGVGHQPYRVVVLSFELLHAPATVCGPKKSTNLVKNKCVNFNFNGLTGTGVLTESNKKFLPFQQFGRDIADITDAVRDPQTLEILDITPCSFGGVSVITPGTNTSNQVAVLYQGVNCTEVPVAIHADQLTPTWRVYSTGSNVFQTRAGCLIGAEYVNNSYECDIPIGAGICASYQTQTKSHRRARSVASQSIIAYTMSLGAENSVAYSNNSIAIPTNFTISVTTEILPVSMTKTSVDCTMYICGDSTECSNLLLQYGSFCTQLKRALTGIAVEQDKNTQEVFAQVKQIYKTPPIKYFGGFNFSQILPDPSKPSKRSFIEDLLFNKVTLADAGFIKQYGDCLGDIAARDLICAQKFNGLTVLPPLLTDEMIAQYTSALLAGTITSGWTFGAGAALQIPFAMQMAYRFNGIGVTQNVLYENQKLIANQFNSAIGKIQDSLSSTASALGKLQDVVNHNAQALNTLVKQLSSKFGAISSVLNDILSRLDPPEAEVQIDRLITGRLQSLQTYVTQQLIRAAEIRASANLAATKMSECVLGQSKRVDFCGKGYHLMSFPQSAPHGVVFLHVTYVPAQEKNFTTAPAICHDGKAHFPREGVFVSNGTHWFVTQRNFYEPQIITTDNTFVSGNCDVVIGIVNNTVYDPLQPELDSFKEELDKYFKNHTSPDVDLGDISGINASVVNIQKEIDRLNEVAKNLNESLIDLQELGKYEQYIKWPWYIWLGFIAGLIAIVMVTIMLCCMTSCCSCLKGCCSCGSCCKFDEDDSEPVLKGVKLHYT

SEQ ID NO: 277 - RNA, 3810 nt, synthetic construct
  source 1..3810: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccacgacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgctgcgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 278 - RNA, 3810 nt, synthetic construct
  source 1..3810: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgctgcgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 279 - RNA, 3810 nt, synthetic construct
  source 1..3810: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaacgaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccgggggggagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgccagcgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 280 - RNA, 3810 nt, synthetic construct
  source 1..3810: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccgggggggagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaaccagccctgcaacggggtggccggccccaactgctacagccccctgcagtcctacgggttccgcccgacctacggcgtggggcaccagccctaccgggtggtcgtgctgagcttcgagctcctgcacgccagcgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 281 - RNA, 3810 nt, synthetic construct
  source 1..3810: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcgtgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 282 - RNA, 3810 nt, synthetic construct
  source 1..3810: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgtggagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 283 - RNA, 3813 nt, synthetic construct
  source 1..3813: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacaacaacaacaagagctggaccgagtccgagttccgggtctacagctccgccaagaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgaaccggtcctacctcacgccgggggacagcagctccgactggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactcccgcgtcagcggcaactacgactacatgtaccgcctgttccgcaagagcaagctcaagcccttcgagcgggacatctccaccgagatctaccaggccggcaacaagccctgcaacggggtgcgcggcagcaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 284 - RNA, 3810 nt, synthetic construct
  source 1..3810: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggtgggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgctgcgcaagagcaagctcaagcccttcgagcgggacatctccaccgagatctaccaggccggcaaccgcccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 285 - RNA, 3810 nt, synthetic construct
  source 1..3810: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccaagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 286 - RNA, 3810 nt, synthetic construct
  source 1..3810: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctgcttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 287 - RNA, 3810 nt, synthetic construct
  source 1..3810: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccacacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 288 - RNA, 3816 nt, synthetic construct
  source 1..3816: mol_type = other RNA
atgttcgtgttcctggtcctcctgcccctggtgagctcccagtgcgtgaacttccgcaccggcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcatcgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacaagaacaacaagagcctgatggagtccggcgtctacagctccgccaacaactgcacgttcgagtacgtgagccagcccttcctgatggacctggagggcaagcaggggaacctgaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccgggggggagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcgacggcaactacaactaccgctaccgcctgttccgcaagagcaacctcaagcccttcgagcgggacatctccaccgagatctaccaggccggcaacaagccctgcaacggggtggccggccccaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtcagcgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgtgtactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccatcgacaacaccttcgtgagcggcaactgcgacgtggtcatcggcatcgtgaacaacacggtgtacgaccccctgcagcccgagctggactccttcaaggaggagctctacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 289 - RNA, 3810 nt, synthetic construct
  source 1..3810: mol_type = other RNA
atgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcacccggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacatcaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtga

SEQ ID NO: 290 - RNA, 4088 nt, synthetic construct
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccacgacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgctgcgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 291 - RNA, 4088 nt, synthetic construct
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgctgcgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 292 - RNA, 4088 nt, synthetic construct
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaacgaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccgggggggagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgccagcgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 293 - RNA, 4088 nt, synthetic construct
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccgggggggagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaaccagccctgcaacggggtggccggccccaactgctacagccccctgcagtcctacgggttccgcccgacctacggcgtggggcaccagccctaccgggtggtcgtgctgagcttcgagctcctgcacgccagcgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 294 - RNA, 4088 nt, synthetic construct
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcgtgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 295 - RNA, 4088 nt, synthetic construct
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgtggagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 296 - RNA, 4091 nt, synthetic construct
  source 1..4091: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacaacaacaacaagagctggaccgagtccgagttccgggtctacagctccgccaagaactgcacgttcgagtacgtgagccagcccttcctgatggacctggagggcaagcaggggaacttcaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgaaccggtcctacctcacgccgggggacagcagctccgactggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactcccgcgtcagcggcaactacgactacatgtaccgcctgttccgcaagagcaagctcaagcccttcgagcgggacatctccaccgagatctaccaggccggcaacaagccctgcaacggggtgcgcggcagcaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 297 - RNA, 4088 nt, synthetic construct
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggtgggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgctgcgcaagagcaagctcaagcccttcgagcgggacatctccaccgagatctaccaggccggcaaccgcccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 298 - RNA, 4088 nt, synthetic construct
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccaagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 299 - RNA, 4088 nt, synthetic construct
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctgcttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 300 - RNA, 4088 nt, synthetic construct
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcaagcggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccacacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 301 - RNA, 4094 nt, synthetic construct
  source 1..4094: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacttccgcaccggcacgcagctgccgcccgcctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggtgctgcccttcaacgacggggtctacttcgcgagcatcgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtactaccacaagaacaacaagagcctgatggagtccggcgtctacagctccgccaacaactgcacgttcgagtacgtgagccagcccttcctgatggacctggagggcaagcaggggaacctgaagaacctccgcgagttcgtgttcaagaacatcgacggctacttcaagatctactccaagcacaccccgatcaacctgggccgggacctgccccaggggttcagcgccctcgagcccctggtggacctgcccatcggcatcaacatcacccgcttccagaccctcctggccctgcaccggtcctacctcacgccgggggggagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttcgacgaggtgttcaacgccaccaccttcgccagcgtctacgcctggaaccgcaagcggatctccaactgcgtggcggactacagcgtgctgtacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaaggtcgacggcaactacaactaccgctaccgcctgttccgcaagagcaacctcaagcccttcgagcgggacatctccaccgagatctaccaggccggcaacaagccctgcaacggggtggccggccccaactgctacttccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacacgaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtcagcgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgtgtactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccatcgacaacaccttcgtgagcggcaactgcgacgtggtcatcggcatcgtgaacaacacggtgtacgaccccctgcagcccgagctggactccttcaaggaggagctctacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 302 - RNA, 4088 nt, synthetic construct
  source 1..4088: mol_type = other RNA
aggagagtcccgcagtcggcgtccagcggctctgcttgttcgtgtgtgtgtcgttgcaggccttattcaagcttaccatgttcgtgttcctggtcctcctgcccctggtgagctcccagtgcgtgaacctcatcacccgcacgcagagctacaccaacagcttcacccggggcgtctactaccccgacaaggtgttccgctccagcgtgctgcactccacccaggacctcttcctgcccttcttcagcaacgtcacgtggttccacgccatccacgtgtccgggaccaacggcaccaagcggttcgacaacccggccctgcccttcaacgacggggtctacttcgcgagcaccgagaagtccaacatcatccgcggctggatcttcgggacgaccctcgacagcaagacccagtccctgctgatcgtgaacaacgccaccaacgtggtcatcaaggtgtgcgagttccagttctgcaacgaccccttcctcgacgtgtaccagaagaacaacaagagctggatggagtccgagttccgggtctacagctccgccaacaactgcacgttcgagtacgtgagccagcccttcctgatggacctggagggcaaggaggggaacttcaagaacctccgcgagttcgtgttcaagaacatcgacggctacttcaagatctactccaagcacaccccgatcaacctggagcgggacctgccccaggggttcagcgccctcgagcccctggtggacctgcccatcggcatcaacatcacccgcttccagaccctcctggccctgcaccggtcctacctcacgccggtggacagcagctccggctggaccgcgggcgccgccgcctactacgtggggtacctgcagccccgcaccttcctgctcaagtacaacgagaacggcaccatcacggacgcggtcgactgcgccctggaccccctgagcgagaccaagtgcaccctcaagtccttcaccgtggagaaggggatctaccagacgagcaacttccgggtgcagcccaccgagtccatcgtccgcttcccgaacatcaccaacctgtgccccttccacgaggtgttcaacgccaccaccttcgccagcgtctacgcctggaaccgcacccggatctccaactgcgtggcggactacagcgtgatctacaacttcgcccccttcttcgccttcaagtgctacggcgtcagccccaccaagctcaacgacctgtgcttcaccaacgtgtacgccgactccttcgtgatccgcgggaacgaggtcagccagatcgcccccggccagaccgggaacatcgccgactacaactacaagctgccggacgacttcacgggctgcgtgatcgcgtggaacagcaacaagctcgactccaagcccagcggcaactacaactacctgtaccgcctgttccgcaagagcaagctcaagcccttcgagcgggacatctccaccgagatctaccaggccggcaacaagccctgcaacggggtggccggccccaactgctacagccccctgcagtcctacgggttccgcccgacctacggcgtggggcaccagccctaccgggtggtcgtgctgagcttcgagctcctgcacgcccccgccacggtgtgcggccccaagaagtccaccaacctggtcaagaacaagtgcgtgaacttcaacttcaacggcctcaccgggaccggcgtgctgaccgagagcaacaagaagttcctgccgttccagcagttcgggcgcgacatcgccgacatcaccgacgcggtccgcgacccccagaccctggagatcctcgacatcaccccctgcagcttcggcggggtgtccgtgatcacgccgggcaccaacaccagcaaccaggtcgccgtgctgtaccagggcgtgaactgcaccgaggtccccgtggccatccacgccgaccagctgacgcccacctggcgggtgtactccaccggcagcaacgtcttccagacccgcgccgggtgcctcatcggcgcggagtacgtgaacaactcctacgagtgcgacatccccatcggggccggcatctgcgccagctaccagacgcagaccaagtcccaccggcgcgcccggagcgtggcgtcccagagcatcatcgcctacaccatgtccctgggcgccgagaacagcgtcgcctactccaacaacagcatcgccatccccaccaacttcacgatctccgtgaccaccgagatcctgcccgtgagcatgaccaagacgagcgtcgactgcaccatgtacatctgcggggactccaccgagtgcagcaacctcctgctgcagtacggctccttctgcacccagctcaagcgcgcgctgacggggatcgccgtggagcaggacaagaacacccaggaggtgttcgcccaggtcaagcagatctacaagacgcccccgatcaagtacttcggcgggttcaacttcagccagatcctgcccgacccctccaagcccagcaagcggtccttcatcgaggacctcctgttcaacaaggtgaccctggccgacgccggcttcatcaagcagtacggcgactgcctcggggacatcgcggcccgcgacctgatctgcgcccagaagttcaacggcctgaccgtgctcccgcccctgctgaccgacgagatgatcgcccagtacaccagcgccctcctggcggggaccatcacgtccggctggaccttcggggccggcgccgccctgcagatccccttcgcgatgcagatggcctaccggttcaacggcatcggggtcacccagaacgtgctctacgagaaccagaagctgatcgccaaccagttcaacagcgccatcggcaagatccaggactccctgagctccaccgccagcgcgctcgggaagctgcaggacgtggtcaaccacaacgcccaggccctgaacacgctcgtgaagcagctgtccagcaagttcggcgccatctccagcgtgctgaacgacatcctctcccgcctggacccgcccgaggccgaggtgcagatcgaccggctgatcaccgggcgcctccagagcctgcagacctacgtgacccagcagctgatccgggcggccgagatccgcgccagcgccaacctcgccgcgaccaagatgtccgagtgcgtcctgggccagagcaagcgggtggacttctgcggcaaggggtaccacctgatgtccttcccccagagcgccccgcacggcgtggtcttcctccacgtgacgtacgtccccgcccaggagaagaacttcaccaccgcccccgcgatctgccacgacgggaaggcccacttcccccgcgagggcgtgttcgtgtccaacgggacccactggttcgtcacgcagcggaacttctacgagccgcagatcatcaccaccgacaacaccttcgtgagcggcaactgcgacgtggtcatcggcatcgtgaacaacacggtgtacgaccccctgcagcccgagctggactccttcaaggaggagctcgacaagtacttcaagaaccacaccagccccgacgtcgacctgggggacatctccggcatcaacgccagcgtggtgaacatccagaaggagatcgaccgcctgaacgaggtcgccaagaacctcaacgagtccctgatcgacctgcaggagctcgggaagtacgagcagtacatcaagtggccgtggtacatctggctgggcttcatcgccggcctgatcgcgatcgtgatggtgaccatcatgctctgctgcatgaccagctgctgctcctgcctgaaggggtgctgcagctgcggctcctgctgcaagttcgacgaggacgacagcgagcccgtcctgaagggggtgaagctccactacacgtgatgatgaggactagtccctgttcccagagcccacttttttttctttttttgaaataaaatagcctgtctttcagatctcaaaggctcttttcagagccaccaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 303 - RNA, 4088 nt, synthetic construct; identical to SEQ ID NO: 290
  source 1..4088: mol_type = other RNA
  modified_base 1..4088: mod_base = m1f

SEQ ID NO: 304 - RNA, 4088 nt, synthetic construct; identical to SEQ ID NO: 291
  source 1..4088: mol_type = other RNA
  modified_base 1..4088: mod_base = m1f

SEQ ID NO: 305 - RNA, 4088 nt, synthetic construct; identical to SEQ ID NO: 292
  source 1..4088: mol_type = other RNA
  modified_base 1..4088: mod_base = m1f

SEQ ID NO: 306 - RNA, 4088 nt, synthetic construct; identical to SEQ ID NO: 293
  source 1..4088: mol_type = other RNA
  modified_base 1..4088: mod_base = m1f

SEQ ID NO: 307 - RNA, 4088 nt, synthetic construct; identical to SEQ ID NO: 294
  source 1..4088: mol_type = other RNA
  modified_base 1..4088: mod_base = m1f

SEQ ID NO: 308 - RNA, 4088 nt, synthetic construct; identical to SEQ ID NO: 295
  source 1..4088: mol_type = other RNA
  modified_base 1..4088: mod_base = m1f

SEQ ID NO: 309 - RNA, 4091 nt, synthetic construct; identical to SEQ ID NO: 296
  source 1..4091: mol_type = other RNA
  modified_base 1..4091: mod_base = m1f

SEQ ID NO: 310 - RNA, 4088 nt, synthetic construct; identical to SEQ ID NO: 297
  source 1..4088: mol_type = other RNA
  modified_base 1..4088: mod_base = m1f

SEQ ID NO: 311 - RNA, 4088 nt, synthetic construct; identical to SEQ ID NO: 298
  source 1..4088: mol_type = other RNA
  modified_base 1..4088: mod_base = m1f

SEQ ID NO: 312 - RNA, 4088 nt, synthetic construct; identical to SEQ ID NO: 299
  source 1..4088: mol_type = other RNA
  modified_base 1..4088: mod_base = m1f

SEQ ID NO: 313 - RNA, 4088 nt, synthetic construct; identical to SEQ ID NO: 300
  source 1..4088: mol_type = other RNA
  modified_base 1..4088: mod_base = m1f

SEQ ID NO: 314 - RNA, 4094 nt, synthetic construct; identical to SEQ ID NO: 301
  source 1..4094: mol_type = other RNA
  modified_base 1..4094: mod_base = m1f

SEQ ID NO: 315 - RNA, 4088 nt, synthetic construct; identical to SEQ ID NO: 302
  source 1..4088: mol_type = other RNA
  modified_base 1..4088: mod_base = m1f

The invention claimed is:

1. An mRNA comprising at least one coding sequence encoding at least one SARS-COV-2 spike protein, wherein said SARS-COV-2 spike protein is at least 95% identical to the amino acid sequence of SEQ ID NO: 162 and comprises the following amino acid substitutions or deletions relative to SEQ ID NO: 1: K986P, V987P, T19I, L24del, P25del, P26del, A27S, V83A, G142D, Y144del, H146Q, Q183E, V213E, G252V, G339H, R346T, L368I, S371F, S